US012807950B2

(12) United States Patent
Praveen et al.

(10) Patent No.: US 12,807,950 B2
(45) **Date of Patent: *Nov. 24, 2026**

(54) TREATMENT OF OPHTHALMIC CONDITIONS WITH SON OF SEVENLESS 2 (SOS2) INHIBITORS

(71) Applicant: Regeneron Pharmaceuticals, Inc., Tarrytown, NY (US)

(72) Inventors: Kavita Praveen, Tarrytown, NY (US); Giovanni Coppola, Tarrytown, NY (US); Manuel Allen Revez Ferreira, Tarrytown, NY (US); Lauren Gurski, Tarrytown, NY (US); Goncalo Abecasis, Tarrytown, NY (US); Aris Baras, Tarrytown, NY (US)

(73) Assignee: Regeneron Pharmaceuticals, Inc., Tarrytown, NY (US)

( * ) Notice: Subject to any disclaimer, the term of this patent is extended or adjusted under 35 U.S.C. 154(b) by 131 days.

This patent is subject to a terminal disclaimer.

(21) Appl. No.: 18/485,592

(22) Filed: Oct. 12, 2023

(65) Prior Publication Data

US 2024/0102013 A1 Mar. 28, 2024

Related U.S. Application Data

(63) Continuation of application No. 17/166,201, filed on Feb. 3, 2021, now Pat. No. 11,820,982.

(60) Provisional application No. 63/026,849, filed on May 19, 2020, provisional application No. 62/969,763, filed on Feb. 4, 2020.

(51) Int. Cl.

| | |
|---|---|
| ***C12N 15/113*** | (2010.01) |
| ***A61K 31/7105*** | (2006.01) |
| ***A61K 38/46*** | (2006.01) |
| ***C12Q 1/6816*** | (2018.01) |
| ***C12Q 1/6883*** | (2018.01) |

(52) U.S. Cl.

CPC ........ *C12N 15/113* (2013.01); *A61K 31/7105* (2013.01); *A61K 38/465* (2013.01); *C12Q 1/6816* (2013.01); *C12Q 1/6883* (2013.01); *C12N 2310/11* (2013.01); *C12N 2310/14* (2013.01); *C12N 2310/20* (2017.05); *C12N 2310/531* (2013.01); *C12Q 2600/118* (2013.01)

(58) Field of Classification Search

None

See application file for complete search history.

(56) References Cited

U.S. PATENT DOCUMENTS

| | | | | |
|---|---|---|---|---|
| 11,820,982 | B2 * | 11/2023 | Praveen | A61K 38/465 |
| 2014/0228364 | A1 | 8/2014 | Hadj-Slimane | |
| 2016/0235753 | A1 | 8/2016 | Ong et al. | |
| 2023/0407299 | A1 * | 12/2023 | Gottesman | A61P 1/16 |

FOREIGN PATENT DOCUMENTS

| | | |
|---|---|---|
| WO | 2019241844 | 12/2019 |

OTHER PUBLICATIONS

Craig et al., "Multitrait analysis of glaucoma identifies new risk loci and enables polygenic prediction of disease susceptibility and progression", Nature Genetics, 2020, 52(2), pp. 160-166.
Cordeddu et al., "Activating Mutations Affecting the Dbl Homology Domain of SOS2 Cause Noonan Syndrome", Human Mutation, 2015, 36(11), pp. 1080-1087.
Van Trier et al., "Ocular Manifestations of Noonan Syndrome A Prospective Clinical and Genetic Study of 25 Patients", Ophthalmology, 2016, 123(10), pp. 2137-2146.
Hartman et al., "Whole-exome sequencing reveals novel genetic variants associated with diverse phenotypes of melanoma cells", Molecular Carcinogenesis, 2018, 58(4), pp. 588-602.
Khawaja et al., "Genome-wide analyses identify 68 new loci associated with intraocular pressure and improve risk prediction for primary open-angle glaucoma", Nature Genetics, 2018, 50(6), pp. 778-782.
Wong et al., "Targeting wild-type KRAS-amplified gastroesophageal cancer through combined MEK and SHP2 inhibition", Nature Medicine, 2018, 24(7), pp. 968-977.
Sheffels et al., "Anchorage-independent growth conditions reveal a differential SOS2 dependence for transformation and survival in RAS-mutant cancer cells", Small GTPases, 2021, 12(1), pp. 67-78.
Macgregor et al., "Genome-wide association study of intraocular pressure uncovers new pathways to glaucoma", Nature Genetics, 2018, 50(8), pp. 1067-1071.
Yamamoto et al., "Rare variants in SOS2 and LZTR1 are associated with Noonan syndrome", Journal of Medical Genetics, 2015, 52(6), pp. 413-421.
Rogge et al., "Genetic dissection of neurodevelopmental pathway: Son of sevenless functions downstream of the sevenless and EGF receptor tyrosine kinases", Cell, 1991, 64(1), pp. 39-48.
Agnifili et al., "Chapter 1—Molecular biomarkers in primary open-angle glaucoma: from noninvasive to invasive", Prog Brian Res, 2015, 221, pp. 1-32.
Rojas et al., "Mammalian son of sevenless Guanine nucleotide exchange factors: old concepts and new perspectives", Genes & Cancer, 2011, 2, pp. 293-305.
Pierre et al., "Understanding SOS (Son of Sevenless)", Biochemical Pharmacology, 2011, 82, pp. 1049-1056.

* cited by examiner

*Primary Examiner* — Brian Whiteman
(74) *Attorney, Agent, or Firm* — Armstrong Teasdale LLP

(57) ABSTRACT

The present disclosure provides methods of treating patients having an ophthalmic condition, methods of identifying subjects having an increased risk of developing an ophthalmic condition, methods of detecting human Son of Sevenless 2 (SOS2) variant nucleic acid molecules and variant polypeptides.

9 Claims, 5 Drawing Sheets

Specification includes a Sequence Listing.

Position: 14:50188639:G:C; cDNA: c.572C>G; Amino acid: p.Pro191Arg

Position: 14:50188639:G:C; cDNA: c.572C>G; Amino acid: p.Pro191Arg

| Study | Cases | Controls | AAF | Effect | p-value |
|---|---|---|---|---|---|
| GHS VCRome | 5,473 I 56 I 0 | 50,594 I 622 I 5 | 0.0061 | 0.82 | 2.2E-01 |
| GHS IDT | 2,595 I 29 I 1 | 64,524 I 807 I 5 | 0.0062 | 0.94 | 6.7E-01 |
| MSSM | 424 I 2 I 0 | 8,752 I 82 I 0 | 0.0045 | 0.51 | 4.4E-01 |
| MDCS | 1,679 I 18 I 0 | 25,637 I 454 I 1 | 0.0085 | 0.60 | 2.0E-02 |
| UKB | 8,484 I 145 I 0 | 443,281 I 9,756 I 49 | 0.0108 | 0.77 | 1.4E-03 |
| **Meta** | **18,655 I 250 I 1** | **592,788 I 11,721 I 60** | **0.0097** | **0.78** | **1.4E-04** |

Position: 14:50188589:C:T; cDNA: c.622G>A; Amino acid: p.Ala208Thr

| Study | Cases | Controls | AAF | Effect | p-value |
|---|---|---|---|---|---|
| GHS VCRome | 5,268 I 258 I 3 | 48,511 I 2,675 I 35 | 0.0265 | 0.86 | 3.0E-02 |
| GHS IDT | 2,500 I 120 I 5 | 61,952 I 3,334 I 44 | 0.0261 | 0.93 | 4.1E-01 |
| MSSM | 416 I 10 I 0 | 8,489 I 339 I 7 | 0.0196 | 0.71 | 2.1E-01 |
| MDCS | 1,616 I 80 I 1 | 24,514 I 1,556 I 22 | 0.0303 | 0.78 | 2.2E-02 |
| UKB | 8,153 I 463 I 8 | 426,067 I 26,373 I 440 | 0.0300 | 0.92 | 7.1E-02 |
| **Meta** | **17,953 I 931 I 17** | **569,533 I 34,277 I 548** | **0.0292** | **0.89** | **4.2E-04** |

TREATMENT OF OPHTHALMIC CONDITIONS WITH SON OF SEVENLESS 2 (SOS2) INHIBITORS

REFERENCE TO SEQUENCE LISTING

This application includes a Sequence Listing submitted electronically as an xml file named 3812039835EQ, created on Oct. 10, 2023, with a size of 608,804 bytes. The Sequence Listing is incorporated herein by reference.

FIELD

The present disclosure relates generally to the treatment of patients having an ophthalmic condition with Son of Sevenless 2 (SOS2) inhibitors, methods of identifying subjects having an increased risk of developing an ophthalmic condition, and methods of detecting SOS2 variant nucleic acid molecules and variant polypeptides.

BACKGROUND

Glaucoma is a collection of disorders that damage the optic nerve of the eye and can result in partial vision loss and blindness. Several types of glaucoma exist, the primary form being open-angle glaucoma, whereby fluid within the eye builds up and increases the pressure inside the eye (intraocular pressure; IOP) to a level that may damage the optic nerve. In low-tension or normal-tension glaucoma, optic nerve damage and narrowed side vision occur in people with normal ocular pressure. In angle-closure glaucoma, the fluid at the front of the eye cannot drain properly, which may lead to a sudden increase in ocular pressure. In congenital glaucoma, children are born with a defect in the eye that slows the normal drainage of fluid. Glaucoma treatments include drug therapy, laser trabeculoplasty, and conventional surgery. While these treatments may save remaining vision, they do not improve sight already lost from glaucoma.

SOS2 is a gene encoding a Ras guanine nucleotide exchange factor that participates in in signaling downstream of receptor tyrosine kinases (RTK), cytokine, and G protein-coupled receptors to activate Ras-ERK pathway. SOS2 is ubiquitously expressed. Heterozygous mutations in SOS2 have recently been found to cause Noonan syndrome, with craniofacial abnormalities and cardiac anomalies (septal defects).

SUMMARY

The present disclosure provides methods of treating a patient having an ophthalmic condition, the method comprising administering an SOS2 inhibitor to the patient. In some embodiments, the patient has increased IOP, glaucoma, pre-glaucoma, and/or decreased corneal hysteresis.

The present disclosure also provides methods of treating a patient with a therapeutic agent that treats or inhibits an ophthalmic condition, wherein the patient is suffering from an ophthalmic condition, the method comprising the steps of: determining whether the patient has an SOS2 predicted loss-of-function variant nucleic acid molecule encoding a human SOS2 polypeptide by: obtaining or having obtained a biological sample from the patient; and performing or having performed a genotyping assay on the biological sample to determine if the patient has a genotype comprising the SOS2 predicted loss-of-function variant nucleic acid molecule; and when the patient is SOS2 reference, then administering or continuing to administer to the patient the therapeutic agent that treats or inhibits an ophthalmic condition in a standard dosage amount, and administering to the patient an SOS2 inhibitor; and when the patient is heterozygous for an SOS2 predicted loss-of-function variant, then administering or continuing to administer to the patient the therapeutic agent that treats or inhibits an ophthalmic condition in an amount that is the same as or lower than a standard dosage amount, and administering to the patient an SOS2 inhibitor; wherein the presence of a genotype having the SOS2 predicted loss-of-function variant nucleic acid molecule encoding the human SOS2 polypeptide indicates the patient has a reduced risk of developing an ophthalmic condition.

The present disclosure also provides methods of identifying a human subject having an increased risk for developing an ophthalmic condition, wherein the method comprises: determining or having determined the presence or absence of an SOS2 predicted loss-of-function variant nucleic acid molecule encoding a human SOS2 polypeptide in a biological sample obtained from the subject; wherein: when the human subject is SOS2 reference, then the human subject has an increased risk for developing an ophthalmic condition; and when the human subject is heterozygous for an SOS2 predicted loss-of-function variant or homozygous for an SOS2 predicted loss-of-function variant, then the human subject has a decreased risk for developing an ophthalmic condition.

The present disclosure also provides methods of detecting a human SOS2 variant nucleic acid molecule in a human subject comprising assaying a sample obtained from the human subject to determine whether a nucleic acid molecule in the sample is: a genomic nucleic acid molecule having a nucleotide sequence comprising: a guanine at a position corresponding to position 42,940 according to SEQ ID NO:2, or the complement thereof; or an adenine at a position corresponding to position 42,990 according to SEQ ID NO:3, or the complement thereof; an mRNA molecule having a nucleotide sequence comprising: a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; or a cDNA molecule produced from an mRNA molecule, wherein the cDNA molecule has a nucleotide sequence comprising: a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50; or an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof.

The present disclosure also provides methods of detecting the presence of a human SOS2 Pro191Arg (Isoform 1), Ala208Thr (Isoform 1), Pro191Arg (Isoform 2), Ala208Thr (Isoform 2), Pro221Arg, or Ala238Thr variant polypeptide, comprising performing an assay on a sample obtained from a human subject to determine whether an SOS2 protein in the sample comprises: an arginine at a position corresponding to position 191 according to SEQ ID NO:55; a threonine at a position corresponding to position 208 according to SEQ ID NO:56; an arginine at a position corresponding to position 191 according to SEQ ID NO:57; a threonine at a position corresponding to position 208 according to SEQ ID NO:58; an arginine at a position corresponding to position 221 according to SEQ ID NO:59; or a threonine at a position corresponding to position 238 according to SEQ ID NO:60.

The present disclosure also provides therapeutic agents that treat or inhibit an ophthalmic condition for use in the treatment of an ophthalmic condition in a human subject having: i) a genomic nucleic acid molecule having a nucleotide sequence encoding a human SOS2 polypeptide, wherein the nucleotide sequence comprises: a guanine at a position corresponding to position 42,940 according to SEQ ID NO:2, or the complement thereof; or an adenine at a position corresponding to position 42,990 according to SEQ ID NO:3, or the complement thereof; ii) an mRNA molecule having a nucleotide sequence encoding a human SOS2 polypeptide, wherein the nucleotide sequence comprises: a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; or iii) a cDNA molecule having a nucleotide sequence encoding a human SOS2 polypeptide, wherein the nucleotide sequence comprises: a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50; or an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof.

The present disclosure also provides SOS2 inhibitors for use in the treatment of an ophthalmic condition in a human subject having: i) a genomic nucleic acid molecule having a nucleotide sequence encoding a human SOS2 polypeptide, wherein the nucleotide sequence comprises: a guanine at a position corresponding to position 42,940 according to SEQ ID NO:2, or the complement thereof; or an adenine at a position corresponding to position 42,990 according to SEQ ID NO:3, or the complement thereof; ii) an mRNA molecule having a nucleotide sequence encoding a human SOS2 polypeptide, wherein the nucleotide sequence comprises: a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; or iii) a cDNA molecule having a nucleotide sequence encoding a human SOS2 polypeptide, wherein the nucleotide sequence comprises: a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50; or an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof.

BRIEF DESCRIPTION OF THE DRAWINGS

The accompanying figures, which are incorporated in and constitute a part of this specification, illustrate several features of the present disclosure.

FIG. 1B=Ala208Thr).

FIG. 2B=Ala208Thr).

DESCRIPTION

Figure 1A:
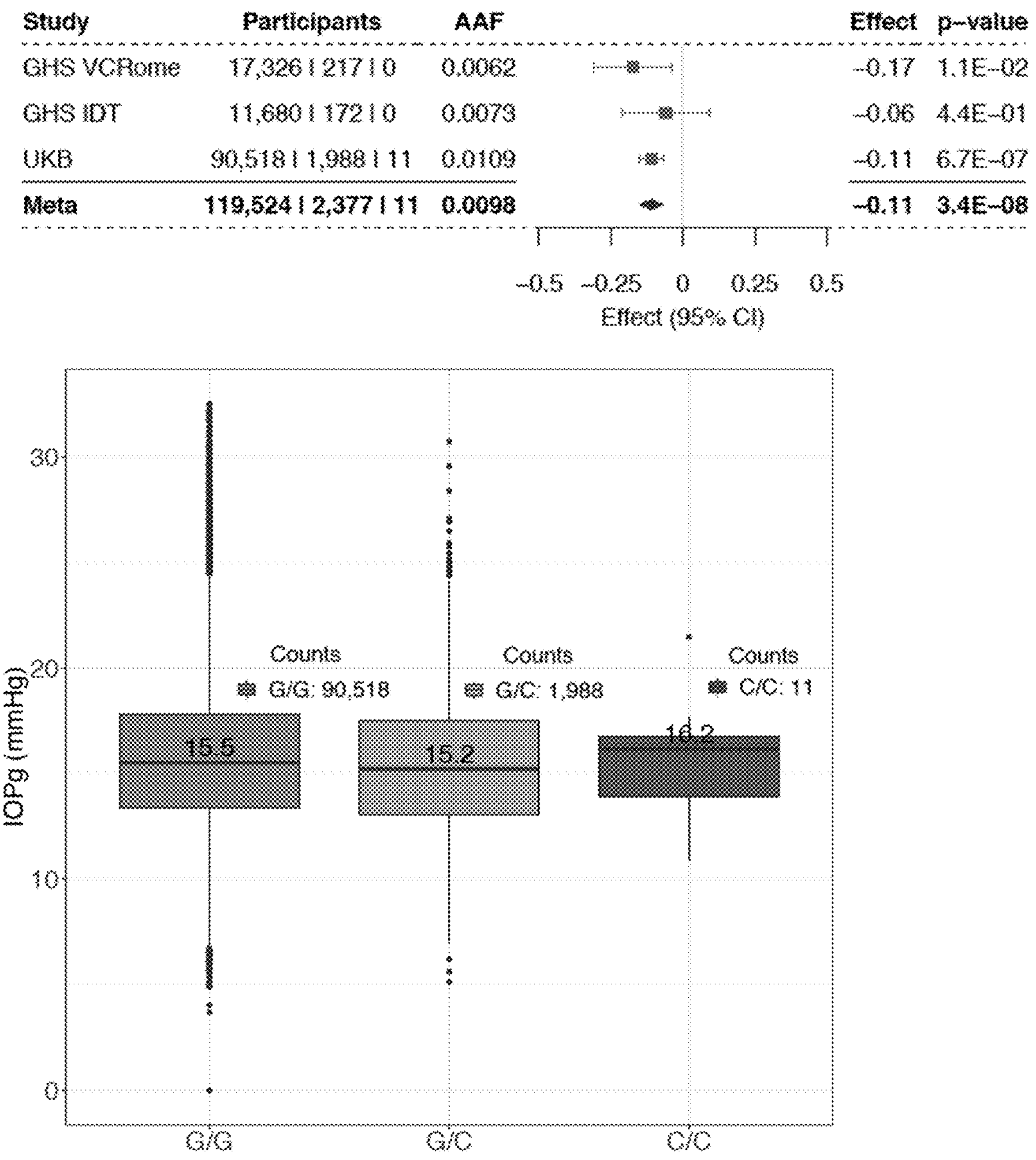
FIGS. 1A and 1B show data demonstrating that two missense variants in SOS2 are associated with reduced IOP (FIG. 1A=Pro191Arg.

Various terms relating to aspects of the present disclosure are used throughout the specification and claims. Such terms are to be given their ordinary meaning in the art, unless otherwise indicated. Other specifically defined terms are to be construed in a manner consistent with the definitions provided herein.

Unless otherwise expressly stated, it is in no way intended that any method or aspect set forth herein be construed as requiring that its steps be performed in a specific order. Accordingly, where a method claim does not specifically state in the claims or descriptions that the steps are to be limited to a specific order, it is in no way intended that an order be inferred, in any respect. This holds for any possible non-expressed basis for interpretation, including matters of logic with respect to arrangement of steps or operational flow, plain meaning derived from grammatical organization or punctuation, or the number or type of aspects described in the specification.

As used herein, the singular forms "a," "an" and "the" include plural referents unless the context clearly dictates otherwise.

As used herein, the term "about" means that the recited numerical value is approximate and small variations would not significantly affect the practice of the disclosed embodiments. Where a numerical value is used, unless indicated otherwise by the context, the term "about" means the numerical value can vary by ±10% and remain within the scope of the disclosed embodiments.

As used herein, the term "comprising" may be replaced with "consisting" or "consisting essentially of" in particular embodiments as desired.

As used herein, the term "isolated", in regard to a nucleic acid molecule or a polypeptide, means that the nucleic acid molecule or polypeptide is in a condition other than its native environment, such as apart from blood and/or animal tissue. In some embodiments, an isolated nucleic acid molecule or polypeptide is substantially free of other nucleic acid molecules or other polypeptides, particularly other nucleic acid molecules or polypeptides of animal origin. In some embodiments, the nucleic acid molecule or polypeptide can be in a highly purified form, i.e., greater than 95% pure or greater than 99% pure. When used in this context, the term "isolated" does not exclude the presence of the same nucleic acid molecule or polypeptide in alternative physical forms, such as dimers or alternatively phosphorylated or derivatized forms.

As used herein, the terms “nucleic acid”, “nucleic acid molecule”, “nucleic acid sequence”, “polynucleotide”, or “oligonucleotide” can comprise a polymeric form of nucleotides of any length, can comprise DNA and/or RNA, and can be single-stranded, double-stranded, or multiple stranded. One strand of a nucleic acid also refers to its complement.

As used herein, the terms “subject” and “patient” are used interchangeably. A subject may include any animal, including mammals. Mammals include, but are not limited to, farm animals (such as, for example, horse, cow, pig), companion animals (such as, for example, dog, cat), laboratory animals (such as, for example, mouse, rat, rabbits), and non-human primates. In some embodiments, the subject is a human.

A rare variant in the SOS2 gene associated with a decreased risk of developing an ophthalmic condition, such as increased IOP and glaucoma in human subjects has been identified in accordance with the present disclosure. For example, a genetic alteration that changes the cytosine nucleotide of position 42,940 in the human SOS2 reference (see, SEQ ID NO:1) to guanine, or the guanine nucleotide of position 42,990 in the human SOS2 reference (see, SEQ ID NO:1) to alanine has been observed to indicate that the human having such an alteration may have a decreased risk of developing an ophthalmic condition, such as increased IOP and glaucoma. Altogether, the genetic analyses described herein surprisingly indicate that the SOS2 gene and, in particular, a variant in the SOS2 gene, associates with a decreased risk of developing an ophthalmic condition, such as increased IOP, glaucoma, pre-glaucoma, and/or decreased corneal hysteresis. Therefore, human subjects that are SOS2 reference that have an increased risk of developing an ophthalmic condition, such as increased IOP, glaucoma, pre-glaucoma, and/or decreased corneal hysteresis, may be treated such that an ophthalmic condition is prevented, the symptoms thereof are reduced, and/or development of symptoms is repressed. Accordingly, the present disclosure provides methods of leveraging the identification of such variants in subjects to identify or stratify risk in such subjects of developing an ophthalmic condition, such as increased IOP, glaucoma, pre-glaucoma, and/or decreased corneal hysteresis, or to diagnose subjects as having an increased risk of developing an ophthalmic condition, such as increased IOP, glaucoma, pre-glaucoma, and/or decreased corneal hysteresis, such that subjects at risk or subjects with active disease may be treated accordingly.

For purposes of the present disclosure, any particular human can be categorized as having one of three SOS2 genotypes: i) SOS2 reference; ii) heterozygous for an SOS2 predicted loss-of-function variant; or iii) homozygous for an SOS2 predicted loss-of-function variant. A human is SOS2 reference when the human does not have a copy of an SOS2 predicted loss-of-function variant nucleic acid molecule. A human is heterozygous for an SOS2 predicted loss-of-function variant when the human has a single copy of an SOS2 predicted loss-of-function variant nucleic acid molecule. AN SOS2 predicted loss-of-function variant nucleic acid molecule is any SOS2 nucleic acid molecule (such as, a genomic nucleic acid molecule, an mRNA molecule, or a cDNA molecule) encoding an SOS2 polypeptide having a partial loss-of-function, a complete loss-of-function, a predicted partial loss-of-function, or a predicted complete loss-of-function. A human who has an SOS2 polypeptide having a partial loss-of-function (or predicted partial loss-of-function) is hypomorphic for SOS2. The SOS2 predicted loss-of-function variant nucleic acid molecule can be any nucleic acid molecule encoding SOS2 Pro191Arg (Isoform 1), Ala208Thr (Isoform 1), Pro191Arg (Isoform 2), Ala208Thr (Isoform 2), Pro221Arg, or Ala238Thr. In some embodiments, the SOS2 predicted loss-of-function variant nucleic acid molecule encodes SOS2 Pro191Arg (Isoform 1) or Ala208Thr (Isoform 1). A human is homozygous for an SOS2 predicted loss-of-function variant when the human has two copies of an SOS2 predicted loss-of-function variant nucleic acid molecule.

For human subjects or patients that are genotyped or determined to be SOS2 reference, such human subjects or patients have an increased risk of developing an ophthalmic condition, such as increased IOP, glaucoma, pre-glaucoma, and/or decreased corneal hysteresis. For human subjects or patients that are genotyped or determined to be either SOS2 reference or heterozygous for an SOS2 predicted loss-of-function variant, such human subjects or patients can be treated with an SOS2 inhibitor.

In any of the embodiments described herein, the SOS2 predicted loss-of-function variant nucleic acid molecule can be any SOS2 nucleic acid molecule (such as, for example, genomic nucleic acid molecule, mRNA molecule, or cDNA molecule) encoding an SOS2 polypeptide having a partial loss-of-function, a complete loss-of-function, a predicted partial loss-of-function, or a predicted complete loss-of-function. For example, the SOS2 predicted loss-of-function variant nucleic acid molecule can be any nucleic acid molecule encoding SOS2 Pro191Arg (Isoform 1), Ala208Thr (Isoform 1), Pro191Arg (Isoform 2), Ala208Thr (Isoform 2), Pro221Arg, or Ala238Thr. In some embodiments, the SOS2 predicted loss-of-function variant nucleic acid molecule encodes SOS2 Pro191Arg (Isoform 1) or Ala208Thr (Isoform 1).

In any of the embodiments described herein, the SOS2 predicted loss-of-function polypeptide can be any SOS2 polypeptide having a partial loss-of-function, a complete loss-of-function, a predicted partial loss-of-function, or a predicted complete loss-of-function. In any of the embodiments described herein, the SOS2 predicted loss-of-function polypeptide can be any of the SOS2 polypeptides described herein including, for example, SOS2 Pro191Arg (Isoform 1), Ala208Thr (Isoform 1), Pro191Arg (Isoform 2), Ala208Thr (Isoform 2), Pro221Arg, or Ala238Thr. In some embodiments, the SOS2 predicted loss-of-function polypeptide is SOS2 Pro191Arg (Isoform 1) or Ala208Thr (Isoform 1).

In any of the embodiments described herein, an ophthalmic condition is increased IOP, glaucoma, pre-glaucoma, and/or decreased corneal hysteresis. In any of the embodiments described herein, an ophthalmic condition is increased IOP. In any of the embodiments described herein, an ophthalmic condition is glaucoma. In any of the embodiments described herein, an ophthalmic condition is pre-glaucoma. In any of the embodiments described herein, an ophthalmic condition is decreased corneal hysteresis.

The present disclosure provides methods of treating a patient having an ophthalmic condition, the methods comprising administering an SOS2 inhibitor to the patient.

The present disclosure also provides methods of treating a patient having increased IOP, the methods comprising administering an SOS2 inhibitor to the patient.

The present disclosure also provides methods of treating a patient having glaucoma, the methods comprising administering an SOS2 inhibitor to the patient.

The present disclosure also provides methods of treating a patient having pre-glaucoma, the methods comprising administering an SOS2 inhibitor to the patient.

The present disclosure also provides methods of treating a patient having decreased corneal hysteresis, the methods comprising administering an SOS2 inhibitor to the patient.

In some embodiments, the SOS2 inhibitor comprises an inhibitory nucleic acid molecule. Examples of inhibitory nucleic acid molecules include, but are not limited to, antisense nucleic acid molecules, small interfering RNAs (siRNAs), and short hairpin RNAs (shRNAs). Such inhibitory nucleic acid molecules can be designed to target any region of an SOS2 mRNA. In some embodiments, the inhibitory nucleic acid molecule hybridizes to a sequence within an SOS2 genomic nucleic acid molecule or mRNA molecule and decreases expression of the SOS2 polypeptide in a cell in the subject. In some embodiments, the SOS2 inhibitor comprises an antisense RNA that hybridizes to an SOS2 genomic nucleic acid molecule or mRNA molecule and decreases expression of the SOS2 polypeptide in a cell in the subject. In some embodiments, the SOS2 inhibitor comprises an siRNA that hybridizes to an SOS2 genomic nucleic acid molecule or mRNA molecule and decreases expression of the SOS2 polypeptide in a cell in the subject. In some embodiments, the SOS2 inhibitor comprises an shRNA that hybridizes to an SOS2 genomic nucleic acid molecule or mRNA molecule and decreases expression of the SOS2 polypeptide in a cell in the subject.

In some embodiments, the SOS2 inhibitor comprises a nuclease agent that induces one or more nicks or double-strand breaks at a recognition sequence(s) or a DNA-binding protein that binds to a recognition sequence within an SOS2 genomic nucleic acid molecule.

The recognition sequence can be located within a coding region of the SOS2 gene, or within regulatory regions that influence the expression of the gene. A recognition sequence of the DNA-binding protein or nuclease agent can be located in an intron, an exon, a promoter, an enhancer, a regulatory region, or any non-protein coding region. The recognition sequence can include or be proximate to the start codon of the SOS2 gene. For example, the recognition sequence can be located about 10, about 20, about 30, about 40, about 50, about 100, about 200, about 300, about 400, about 500, or about 1,000 nucleotides from the start codon. As another example, two or more nuclease agents can be used, each targeting a nuclease recognition sequence including or proximate to the start codon. As another example, two nuclease agents can be used, one targeting a nuclease recognition sequence including or proximate to the start codon, and one targeting a nuclease recognition sequence including or proximate to the stop codon, wherein cleavage by the nuclease agents can result in deletion of the coding region between the two nuclease recognition sequences. Any nuclease agent that induces a nick or double-strand break into a desired recognition sequence can be used in the methods and compositions disclosed herein. Any DNA-binding protein that binds to a desired recognition sequence can be used in the methods and compositions disclosed herein.

Suitable nuclease agents and DNA-binding proteins for use herein include, but are not limited to, zinc finger protein or zinc finger nuclease (ZFN) pair, Transcription Activator-Like Effector (TALE) protein or Transcription Activator-Like Effector Nuclease (TALEN), or Clustered Regularly Interspersed Short Palindromic Repeats (CRISPR)/CRISPR-associated (Cas) systems. The length of the recognition sequence can vary, and includes, for example, recognition sequences that are about 30-36 bp for a zinc finger protein or ZFN pair, about 15-18 bp for each ZFN, about 36 bp for a TALE protein or TALEN, and about 20 bp for a CRISPR/Cas guide RNA.

In some embodiments, CRISPR/Cas systems can be used to modify an SOS2 genomic nucleic acid molecule within a cell. The methods and compositions disclosed herein can employ CRISPR-Cas systems by utilizing CRISPR complexes (comprising a guide RNA (gRNA) complexed with a Cas protein) for site-directed cleavage of SOS2 nucleic acid molecules.

Cas proteins generally comprise at least one RNA recognition or binding domain that can interact with gRNAs. Cas proteins can also comprise nuclease domains (such as, for example, DNase or RNase domains), DNA binding domains, helicase domains, protein-protein interaction domains, dimerization domains, and other domains. Suitable Cas proteins include, for example, a wild type Cas9 protein and a wild type Cpf1 protein (such as, for example, FnCpf1). A Cas protein can have full cleavage activity to create a double-strand break in an SOS2 genomic nucleic acid molecule or it can be a nickase that creates a single-strand break in an SOS2 genomic nucleic acid molecule. Additional examples of Cas proteins include, but are not limited to, Cas1, Cas1B, Cast, Cas3, Cas4, Cas5, Cas5e (CasD), Cas6, Cas6e, Cas6f, Cas7, Cas8a1, Cas8a2, Cas8b, Cas8c, Cas9 (Csn1 or Csx12), Cas10, Cas10d, CasF, CasG, CasH, Csy1, Csy2, Csy3, Cse1 (CasA), Cse2 (CasB), Cse3 (CasE), Cse4 (CasC), Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, and Cu1966, and homologs or modified versions thereof. Cas proteins can also be operably linked to heterologous polypeptides as fusion proteins. For example, a Cas protein can be fused to a cleavage domain, an epigenetic modification domain, a transcriptional activation domain, or a transcriptional repressor domain. Cas proteins can be provided in any form. For example, a Cas protein can be provided in the form of a protein, such as a Cas protein complexed with a gRNA. Alternately, a Cas protein can be provided in the form of a nucleic acid molecule encoding the Cas protein, such as an RNA or DNA.

In some embodiments, targeted genetic modifications of SOS2 genomic nucleic acid molecules can be generated by contacting a cell with a Cas protein and one or more gRNAs that hybridize to one or more gRNA recognition sequences within a target genomic locus in the SOS2 genomic nucleic acid molecule. For example, a gRNA recognition sequence can be located within a region of SEQ ID NO:1. The gRNA recognition sequence can also include or be proximate to a position corresponding to: position 42,940, or position 42,990 according to SEQ ID NO:1. For example, the gRNA recognition sequence can be located from about 1000, from about 500, from about 400, from about 300, from about 200, from about 100, from about 50, from about 45, from about 40, from about 35, from about 30, from about 25, from about 20, from about 15, from about 10, or from about 5 nucleotides of a position corresponding to: position 42,940, or position 42,990 according to SEQ ID NO:1. The gRNA recognition sequence can include or be proximate to the start codon of an SOS2 genomic nucleic acid molecule or the stop codon of an SOS2 genomic nucleic acid molecule. For example, the gRNA recognition sequence can be located from about 10, from about 20, from about 30, from about 40, from about 50, from about 100, from about 200, from about 300, from about 400, from about 500, or from about 1,000 nucleotides of the start codon or the stop codon.

The gRNA recognition sequences within a target genomic locus in an SOS2 genomic nucleic acid molecule are located near a Protospacer Adjacent Motif (PAM) sequence, which is a 2-6 base pair DNA sequence immediately following the DNA sequence targeted by the Cas9 nuclease. The canonical PAM is the sequence 5'-NGG-3' where "N" is any nucleobase followed by two guanine ("G") nucleobases. gRNAs can transport Cas9 to anywhere in the genome for gene editing, but no editing can occur at any site other than one at which Cas9 recognizes PAM. In addition, 5'-NGA-3' can be a highly efficient non-canonical PAM for human cells. Generally, the PAM is about 2-6 nucleotides downstream of the DNA sequence targeted by the gRNA. The PAM can flank the gRNA recognition sequence. In some embodiments, the gRNA recognition sequence can be flanked on the 3' end by the PAM. In some embodiments, the gRNA recognition sequence can be flanked on the 5' end by the PAM. For example, the cleavage site of Cas proteins can be about 1 to about 10, about 2 to about 5 base pairs, or three base pairs upstream or downstream of the PAM sequence. In some embodiments (such as when Cas9 from *S. pyogenes* or a closely related Cas9 is used), the PAM sequence of the non-complementary strand can be 5'-NGG-3', where N is any DNA nucleotide and is immediately 3' of the gRNA recognition sequence of the non-complementary strand of the target DNA. As such, the PAM sequence of the complementary strand would be 5'-CCN-3', where N is any DNA nucleotide and is immediately 5' of the gRNA recognition sequence of the complementary strand of the target DNA.

A gRNA is an RNA molecule that binds to a Cas protein and targets the Cas protein to a specific location within an SOS2 genomic nucleic acid molecule. An exemplary gRNA is a gRNA effective to direct a Cas enzyme to bind to or cleave an SOS2 genomic nucleic acid molecule, wherein the gRNA comprises a DNA-targeting segment that hybridizes to a gRNA recognition sequence within the SOS2 genomic nucleic acid molecule that includes or is proximate to a position corresponding to: position 42,940, or position 42,990. For example, a gRNA can be selected such that it hybridizes to a gRNA recognition sequence that is located from about 5, from about 10, from about 15, from about 20, from about 25, from about 30, from about 35, from about 40, from about 45, from about 50, from about 100, from about 200, from about 300, from about 400, from about 500, or from about 1,000 nucleotides of a position corresponding to: position 42,940, or position 42,990. Other exemplary gRNAs comprise a DNA-targeting segment that hybridizes to a gRNA recognition sequence present within an SOS2 genomic nucleic acid molecule that includes or is proximate to the start codon or the stop codon. For example, a gRNA can be selected such that it hybridizes to a gRNA recognition sequence that is located from about 5, from about 10, from about 15, from about 20, from about 25, from about 30, from about 35, from about 40, from about 45, from about 50, from about 100, from about 200, from about 300, from about 400, from about 500, or from about 1,000 nucleotides of the start codon or located from about 5, from about 10, from about 15, from about 20, from about 25, from about 30, from about 35, from about 40, from about 45, from about 50, from about 100, from about 200, from about 300, from about 400, from about 500, or from about 1,000 nucleotides of the stop codon. Suitable gRNAs can comprise from about 17 to about 25 nucleotides, from about 17 to about 23 nucleotides, from about 18 to about 22 nucleotides, or from about 19 to about 21 nucleotides. In some embodiments, the gRNAs can comprise nucleotides.

Examples of suitable gRNA recognition sequences located within the human SOS2 reference gene are set forth in Table 1 as SEQ ID NOS:61-71.

TABLE 1

Guide RNA Recognition Sequences Near SOS2 Variation(s)

| SEQ ID NO | Orientation | Sequence |
|---|---|---|
| 61 | + | AGTGTCAATGTGTGCGGATAAGG |
| 62 | + | GTGTGCGGATAAGGTTTTGATGG |
| 63 | + | TGATCAGGATGACATAGGTTTGG |
| 64 | + | TTTGATGGACATGTTTGATCAGG |
| 65 | + | CATTAAAGTGTCAATGTGTGCGG |
| 66 | + | GAAGATGAACCTAGTTCTTCTGG |
| 67 | + | ATGTTTGATCAGGATGACATAGG |
| 68 | + | AGAAGAAAGACAGTATCTACGGG |
| 69 | - | TTTAATTCACCAGAAGAACTAGG |
| 70 | + | CAGAAGAAAGACAGTATCTACGG |
| 71 | - | CAGCTTTCTATCAGAAAGAAAGG |

The Cas protein and the gRNA form a complex, and the Cas protein cleaves the target SOS2 genomic nucleic acid molecule. The Cas protein can cleave the nucleic acid molecule at a site within or outside of the nucleic acid sequence present in the target SOS2 genomic nucleic acid molecule to which the DNA-targeting segment of a gRNA will bind. For example, formation of a CRISPR complex (comprising a gRNA hybridized to a gRNA recognition sequence and complexed with a Cas protein) can result in cleavage of one or both strands in or near (such as, for example, within 1, 2, 3, 4, 5, 6, 7, 8, 9, 10, 20, 50, or more base pairs from) the nucleic acid sequence present in the SOS2 genomic nucleic acid molecule to which a DNA-targeting segment of a gRNA will bind.

Such methods can result, for example, in an SOS2 genomic nucleic acid molecule in which a region of SEQ ID NO:1 is disrupted, the start codon is disrupted, the stop codon is disrupted, or the coding sequence is disrupted or deleted. Optionally, the cell can be further contacted with one or more additional gRNAs that hybridize to additional gRNA recognition sequences within the target genomic locus in the SOS2 genomic nucleic acid molecule. By contacting the cell with one or more additional gRNAs (such as, for example, a second gRNA that hybridizes to a second gRNA recognition sequence), cleavage by the Cas protein can create two or more double-strand breaks or two or more single-strand breaks.

In some embodiments, the SOS2 inhibitor comprises a small molecule. In some embodiments, the SOS2 inhibitor is a quinazoline compound.

In some embodiments, the methods of treatment further comprise detecting the presence or absence of an SOS2 predicted loss-of-function variant nucleic acid molecule encoding a human SOS2 polypeptide in a biological sample from the patient. As used throughout the present disclosure, a "SOS2 predicted loss-of-function variant nucleic acid molecule" is any SOS2 nucleic acid molecule (such as, for example, genomic nucleic acid molecule, mRNA molecule, or cDNA molecule) encoding an SOS2 polypeptide having a partial loss-of-function, a complete loss-of-function, a predicted partial loss-of-function, or a predicted complete loss-of-function.

The present disclosure also provides methods of treating a patient with a therapeutic agent that treats or inhibits an ophthalmic condition, wherein the patient is suffering from an ophthalmic condition. In some embodiments, the methods comprise determining whether the patient has an SOS2 predicted loss-of-function variant nucleic acid molecule encoding a human SOS2 polypeptide by obtaining or having obtained a biological sample from the patient, and performing or having performed a genotyping assay on the biological sample to determine if the patient has a genotype comprising the SOS2 predicted loss-of-function variant nucleic acid molecule. When the patient is SOS2 reference, the therapeutic agent that treats or inhibits an ophthalmic condition is administered or continued to be administered to the patient in a standard dosage amount, and an SOS2 inhibitor is administered to the patient. When the patient is heterozygous for an SOS2 predicted loss-of-function variant, the therapeutic agent that treats or inhibits an ophthalmic condition is administered or continued to be administered to the patient in an amount that is the same as or lower than a standard dosage amount, and an SOS2 inhibitor is administered to the patient. The presence of a genotype having the SOS2 predicted loss-of-function variant nucleic acid molecule encoding the human SOS2 polypeptide indicates the patient has a reduced risk of developing an ophthalmic condition. In some embodiments, the patient is SOS2 reference. In some embodiments, the patient is heterozygous for an SOS2 predicted loss-of-function variant.

For human subjects or patients that are genotyped or determined to be either SOS2 reference or heterozygous for an SOS2 predicted loss-of-function variant, such human subjects or patients can be treated with an SOS2 inhibitor, as described herein.

Detecting the presence or absence of an SOS2 predicted loss-of-function variant nucleic acid molecule in a biological sample from a patient and/or determining whether a patient has an SOS2 predicted loss-of-function variant nucleic acid molecule can be carried out by any of the methods described herein. In some embodiments, these methods can be carried out in vitro. In some embodiments, these methods can be carried out in situ. In some embodiments, these methods can be carried out in vivo. In any of these embodiments, the nucleic acid molecule can be present within a cell obtained from the human subject.

In some embodiments, when the patient is SOS2 reference, the patient is also administered a therapeutic agent that treats or inhibits an ophthalmic condition in a standard dosage amount. In some embodiments, when the patient is heterozygous for an SOS2 predicted loss-of-function variant, the patient is also administered a therapeutic agent that treats or inhibits an ophthalmic condition in a dosage amount that is the same as or lower than a standard dosage amount.

In some embodiments, the treatment methods further comprise detecting the presence or absence of an SOS2 predicted loss-of-function polypeptide in a biological sample from the patient. In some embodiments, when the patient does not have an SOS2 predicted loss-of-function polypeptide, the patient is also administered a therapeutic agent that treats or inhibits an ophthalmic condition in a standard dosage amount. In some embodiments, when the patient has an SOS2 predicted loss-of-function polypeptide, the patient is also administered a therapeutic agent that treats or inhibits an ophthalmic condition in a dosage amount that is the same as or lower than a standard dosage amount.

The present disclosure also provides methods of treating a patient with a therapeutic agent that treats or inhibits an ophthalmic condition, wherein the patient is suffering from an ophthalmic condition. In some embodiments, the method comprises determining whether the patient has an SOS2 predicted loss-of-function polypeptide by obtaining or having obtained a biological sample from the patient, and performing or having performed an assay on the biological sample to determine if the patient has an SOS2 predicted loss-of-function polypeptide. When the patient does not have an SOS2 predicted loss-of-function polypeptide, the therapeutic agent that treats or inhibits an ophthalmic condition is administered or continued to be administered to the patient in a standard dosage amount, and an SOS2 inhibitor is administered to the patient. When the patient has an SOS2 predicted loss-of-function polypeptide, the therapeutic agent that treats or inhibits an ophthalmic condition is administered or continued to be administered to the patient in an amount that is the same as or lower than a standard dosage amount, and an SOS2 inhibitor is administered to the patient. The presence of an SOS2 predicted loss-of-function polypeptide indicates the patient has a reduced risk of developing an ophthalmic condition. In some embodiments, the patient has an SOS2 predicted loss-of-function polypeptide. In some embodiments, the patient does not have an SOS2 predicted loss-of-function polypeptide.

Detecting the presence or absence of an SOS2 predicted loss-of-function polypeptide in a biological sample from a patient and/or determining whether a patient has an SOS2 predicted loss-of-function polypeptide can be carried out by any of the methods described herein. In some embodiments, these methods can be carried out in vitro. In some embodiments, these methods can be carried out in situ. In some embodiments, these methods can be carried out in vivo. In any of these embodiments, the polypeptide can be present within a cell obtained from the human subject.

Examples of therapeutic agents that treat or inhibit an ophthalmic condition include, but are not limited to: a prostaglandin, a beta blocker, an alpha-adrenergic agonist, a carbonic anhydrase inhibitor, a rho kinase inhibitor, or a miotic or cholinergic agent.

In some embodiments, the therapeutic agent that treats or inhibits the ophthalmic condition is a prostaglandin. In some embodiments, the prostaglandin is XALATAN® (latanoprost), TRAVATAN Z® (travoprost), ZIOPTAN® (tafluprost), LUMIGAN® (bimatoprost), or VYZULTA® (latanoprostene bunod), or any combination thereof.

In some embodiments, the therapeutic agent that treats or inhibits the ophthalmic condition is a beta blocker. In some embodiments, the beta blocker is BETIMOL®, ISTALOL®, or TIMOPTIC® (timolol) or BETOPTIC® (betaxolol), or any combination thereof.

In some embodiments, the therapeutic agent that treats or inhibits the ophthalmic condition is an alpha-adrenergic agonist. In some embodiments, the alpha-adrenergic agonist is IOPIDINE® (apraclonidine) or ALPHAGAN® or QOLIANA® (brimonidine), or any combination thereof.

In some embodiments, the therapeutic agent that treats or inhibits the ophthalmic condition is a carbonic anhydrase inhibitor. In some embodiments, the carbonic anhydrase inhibitor is TRUSOPT® (dorzolamide) or AZOPT® (brinzolamide), or a combination thereof.

In some embodiments, the therapeutic agent that treats or inhibits the ophthalmic condition is a rho kinase inhibitor. In some embodiments, the rho kinase inhibitor is RHOPRESSA® (netarsudil).

In some embodiments, the therapeutic agent that treats or inhibits the ophthalmic condition is a miotic or cholinergic agent. In some embodiments, the miotic or cholinergic agent is ISOPTO® Carpine (pilocarpine).

In some embodiments, the dose of the therapeutic agents that treat or inhibit an ophthalmic condition can be reduced by about 10%, by about 20%, by about 30%, by about 40%, by about 50%, by about 60%, by about 70%, by about 80%, or by about 90% for patients or human subjects that are heterozygous for an SOS2 predicted loss-of-function variant (i.e., a lower than the standard dosage amount) compared to patients or human subjects that are SOS2 reference (who may receive a standard dosage amount). In some embodiments, the dose of the therapeutic agents that treat or inhibit an ophthalmic condition can be reduced by about 10%, by about 20%, by about 30%, by about 40%, or by about 50%. In addition, the dose of therapeutic agents that treat or inhibit an ophthalmic condition in patients or human subjects that are heterozygous for an SOS2 predicted loss-of-function variant can be administered less frequently compared to patients or human subjects that are SOS2 reference.

Administration of the therapeutic agents that treat or inhibit an ophthalmic condition and/or SOS2 inhibitors can be repeated, for example, after one day, two days, three days, five days, one week, two weeks, three weeks, one month, five weeks, six weeks, seven weeks, eight weeks, two months, or three months. The repeated administration can be at the same dose or at a different dose. The administration can be repeated once, twice, three times, four times, five times, six times, seven times, eight times, nine times, ten times, or more. For example, according to certain dosage regimens a patient can receive therapy for a prolonged period of time such as, for example, 6 months, 1 year, or more.

Administration of the therapeutic agents that treat or inhibit an ophthalmic condition and/or SOS2 inhibitors can occur by any suitable route including, but not limited to, parenteral, intravenous, oral, subcutaneous, intra-arterial, intracranial, intrathecal, intraperitoneal, topical, intranasal, or intramuscular. Pharmaceutical compositions for administration are desirably sterile and substantially isotonic and manufactured under GMP conditions. Pharmaceutical compositions can be provided in unit dosage form (i.e., the dosage for a single administration). Pharmaceutical compositions can be formulated using one or more physiologically and pharmaceutically acceptable carriers, diluents, excipients or auxiliaries. The formulation depends on the route of administration chosen. The term "pharmaceutically acceptable" means that the carrier, diluent, excipient, or auxiliary is compatible with the other ingredients of the formulation and not substantially deleterious to the recipient thereof.

The terms "treat", "treating", and "treatment" and "prevent", "preventing", and "prevention" as used herein, refer to eliciting the desired biological response, such as a therapeutic and prophylactic effect, respectively. In some embodiments, a therapeutic effect comprises one or more of a decrease/reduction in an ophthalmic condition, a decrease/reduction in the severity of an ophthalmic condition (such as, for example, a reduction or inhibition of development of an ophthalmic condition), a decrease/reduction in symptoms and ophthalmic condition-related effects, delaying the onset of symptoms and ophthalmic condition-related effects, reducing the severity of symptoms of ophthalmic condition-related effects, reducing the severity of an acute episode, reducing the number of symptoms and ophthalmic condition-related effects, reducing the latency of symptoms and ophthalmic condition-related effects, an amelioration of symptoms and ophthalmic condition-related effects, reducing secondary symptoms, reducing secondary infections, preventing relapse to an ophthalmic condition, decreasing the number or frequency of relapse episodes, increasing latency between symptomatic episodes, increasing time to sustained progression, expediting remission, inducing remission, augmenting remission, speeding recovery, or increasing efficacy of or decreasing resistance to alternative therapeutics, and/or an increased survival time of the affected host animal, following administration of the agent or composition comprising the agent. A prophylactic effect may comprise a complete or partial avoidance/inhibition or a delay of ophthalmic condition development/progression (such as, for example, a complete or partial avoidance/inhibition or a delay), and an increased survival time of the affected host animal, following administration of a therapeutic protocol. Treatment of an ophthalmic condition encompasses the treatment of patients already diagnosed as having any form of an ophthalmic condition at any clinical stage or manifestation, the delay of the onset or evolution or aggravation or deterioration of the symptoms or signs of an ophthalmic condition, and/or preventing and/or reducing the severity of an ophthalmic condition.

The present disclosure also provides methods of identifying a human subject having an increased risk for developing an ophthalmic condition. In some embodiments, the method comprises determining or having determined in a biological sample obtained from the subject the presence or absence of an SOS2 predicted loss-of-function variant nucleic acid molecule (such as a genomic nucleic acid molecule, mRNA molecule, and/or cDNA molecule) encoding a human SOS2 polypeptide. When the human subject lacks an SOS2 predicted loss-of-function variant nucleic acid molecule (i.e., the human subject is genotypically categorized as an SOS2 reference), then the human subject has an increased risk for developing an ophthalmic condition. When the human subject has an SOS2 predicted loss-of-function variant nucleic acid molecule (i.e., the human subject is heterozygous for an SOS2 predicted loss-of-function variant or homozygous for an SOS2 predicted loss-of-function variant), then the human subject has a decreased risk for developing an ophthalmic condition.

Having a single copy of an SOS2 predicted loss-of-function variant nucleic acid molecule is more protective of a human subject from developing an ophthalmic condition than having no copies of an SOS2 predicted loss-of-function variant nucleic acid molecule. Without intending to be limited to any particular theory or mechanism of action, it is believed that a single copy of an SOS2 predicted loss-of-function variant nucleic acid molecule (i.e., heterozygous for an SOS2 predicted loss-of-function variant) is protective of a human subject from developing an ophthalmic condition, and it is also believed that having two copies of an SOS2 predicted loss-of-function variant nucleic acid molecule (i.e., homozygous for an SOS2 predicted loss-of-function variant) may be more protective of a human subject from developing an ophthalmic condition, relative to a human subject with a single copy. Thus, in some embodiments, a single copy of an SOS2 predicted loss-of-function variant nucleic acid molecule may not be completely protective, but instead, may be partially or incompletely protective of a human subject from developing an ophthalmic condition. While not desiring to be bound by any particular theory, there may be additional factors or molecules involved in the development of an ophthalmic condition that are still present in a human subject having a single copy of an SOS2 predicted loss-of-function variant nucleic acid molecule, thus resulting in less than complete protection from the development of an ophthalmic condition.

Determining whether a human subject has an SOS2 predicted loss-of-function variant nucleic acid molecule in a biological sample from a patient and/or determining whether a patient has an SOS2 predicted loss-of-function variant nucleic acid molecule can be carried out by any of the methods described herein. In some embodiments, these methods can be carried out in vitro. In some embodiments, these methods can be carried out in situ. In some embodiments, these methods can be carried out in vivo. In any of these embodiments, the nucleic acid molecule can be present within a cell obtained from the human subject.

In some embodiments, when a human subject is identified as having an increased risk of developing an ophthalmic condition, the human subject is further treated with a therapeutic agent that treats or inhibits an ophthalmic condition and/or an SOS2 inhibitor, as described herein. For example, when the human subject is SOS2 reference, and therefore has an increased risk for developing an ophthalmic condition, the human subject is administered an SOS2 inhibitor. In some embodiments, such a patient is also administered a therapeutic agent that treats or inhibits an ophthalmic condition. In some embodiments, when the patient is heterozygous for an SOS2 predicted loss-of-function variant, the patient is administered the therapeutic agent that treats or inhibits an ophthalmic condition in a dosage amount that is the same as or lower than a standard dosage amount, and is also administered an SOS2 inhibitor. In some embodiments, the patient is SOS2 reference. In some embodiments, the patient is heterozygous for an SOS2 predicted loss-of-function variant.

The present disclosure also provides methods of detecting the presence or absence of an SOS2 predicted loss-of-function variant genomic nucleic acid molecule in a biological sample from a human subject, and/or an SOS2 predicted loss-of-function variant mRNA molecule in a biological sample from a human subject, and/or an SOS2 predicted loss-of-function variant cDNA molecule produced from an mRNA molecule in a biological sample from a human subject. It is understood that gene sequences within a population and mRNA molecules encoded by such genes can vary due to polymorphisms such as single-nucleotide polymorphisms. The sequences provided herein for the SOS2 variant genomic nucleic acid molecule, SOS2 variant mRNA molecule, and SOS2 variant cDNA molecule are only exemplary sequences. Other sequences for the SOS2 variant genomic nucleic acid molecule, variant mRNA molecule, and variant cDNA molecule are also possible.

The biological sample can be derived from any cell, tissue, or biological fluid from the subject. The sample may comprise any clinically relevant tissue, such as a bone marrow sample, a tumor biopsy, a fine needle aspirate, or a sample of bodily fluid, such as blood, gingival crevicular fluid, plasma, serum, lymph, ascitic fluid, cystic fluid, or urine. In some cases, the sample comprises a buccal swab. The sample used in the methods disclosed herein will vary based on the assay format, nature of the detection method, and the tissues, cells, or extracts that are used as the sample. A biological sample can be processed differently depending on the assay being employed. For example, when detecting any SOS2 variant nucleic acid molecule, preliminary processing designed to isolate or enrich the sample for the genomic DNA can be employed. A variety of techniques may be used for this purpose. When detecting the level of any SOS2 variant mRNA, different techniques can be used enrich the biological sample with mRNA. Various methods to detect the presence or level of an mRNA or the presence of a particular variant genomic DNA locus can be used.

In some embodiments, detecting a human SOS2 predicted loss-of-function variant nucleic acid molecule in a human subject comprises assaying or genotyping a biological sample obtained from the human subject to determine whether an SOS2 genomic nucleic acid molecule in the biological sample, and/or an SOS2 mRNA molecule in the biological sample, and/or an SOS2 cDNA molecule produced from an mRNA molecule in the biological sample, comprises one or more variations that cause a loss-of-function (partial or complete) or are predicted to cause a loss-of-function (partial or complete).

In some embodiments, the methods of detecting the presence or absence of an SOS2 predicted loss-of-function variant nucleic acid molecule (such as, for example, a genomic nucleic acid molecule, an mRNA molecule, and/or a cDNA molecule produced from an mRNA molecule) in a human subject, comprise performing an assay on a biological sample obtained from the human subject. The assay determines whether a nucleic acid molecule in the biological sample comprises a particular nucleotide sequence.

In some embodiments, the nucleotide sequence comprises: a guanine at a position corresponding to position 42,940 according to SEQ ID NO:2 (for genomic nucleic acid molecules); a guanine at a position corresponding to position 598 according to SEQ ID NO:12, a guanine at a position corresponding to position 598 according to SEQ ID NO:14, a guanine at a position corresponding to position 598 according to SEQ ID NO:16, a guanine at a position corresponding to position 572 according to SEQ ID NO:18, a guanine at a position corresponding to position 591 according to SEQ ID NO:20, a guanine at a position corresponding to position 640 according to SEQ ID NO:22, a guanine at a position corresponding to position 581 according to SEQ ID NO:24, or a guanine at a position corresponding to position 662 according to SEQ ID NO:26 (for mRNA molecules); or a guanine at a position corresponding to position 598 according to SEQ ID NO:36, a guanine at a position corresponding to position 598 according to SEQ ID NO:38, a guanine at a position corresponding to position 598 according to SEQ ID NO:40, a guanine at a position corresponding to position 572 according to SEQ ID NO:42, a guanine at a position corresponding to position 591 according to SEQ ID NO:44, a guanine at a position corresponding to position 640 according to SEQ ID NO:46, a guanine at a position corresponding to position 581 according to SEQ ID NO:48, or a guanine at a position corresponding to position 662 according to SEQ ID NO:50 (for cDNA molecules obtained from mRNA molecules).

In some embodiments, the nucleotide sequence comprises: an adenine at a position corresponding to position 42,990 according to SEQ ID NO:3 (for genomic nucleic acid molecules); an adenine at a position corresponding to position 648 according to SEQ ID NO:13, an adenine at a position corresponding to position 648 according to SEQ ID NO:15, an adenine at a position corresponding to position 648 according to SEQ ID NO:17, an adenine at a position corresponding to position 622 according to SEQ ID NO:19, an adenine at a position corresponding to position 641 according to SEQ ID NO:21, an adenine at a position corresponding to position 690 according to SEQ ID NO:23, an adenine at a position corresponding to position 631 according to SEQ ID NO:25, or an adenine at a position corresponding to position 712 according to SEQ ID NO:27 (for mRNA molecules); or an adenine at a position corresponding to position 648 according to SEQ ID NO:37, an adenine at a position corresponding to position 648 according to SEQ ID NO:39, an adenine at a position corresponding to position 648 according to SEQ ID NO:41, an adenine at a position corresponding to position 622 according to SEQ ID NO:43, an adenine at a position corresponding to position 641 according to SEQ ID NO:45, an adenine at a position corresponding to position 690 according to SEQ ID NO:47, an adenine at a position corresponding to position 631 according to SEQ ID NO:49, or an adenine at a position corresponding to position 712 according to SEQ ID NO:51.

In some embodiments, the nucleotide sequence comprises: a guanine at a position corresponding to position 42,940 according to SEQ ID NO:2, or the complement thereof; or an adenine at a position corresponding to position 42,990 according to SEQ ID NO:3, or the complement thereof.

In some embodiments, the nucleotide sequence comprises: a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof.

In some embodiments, the nucleotide sequence comprises: a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50; or an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof.

In some embodiments, the biological sample comprises a cell or cell lysate. Such methods can further comprise, for example, obtaining a biological sample from the subject comprising an SOS2 genomic nucleic acid molecule or mRNA molecule, and if mRNA, optionally reverse transcribing the mRNA into cDNA. Such assays can comprise, for example determining the identity of these positions of the particular SOS2 nucleic acid molecule. In some embodiments, the method is an in vitro method.

In some embodiments, the determining step, detecting step, or genotyping assay comprises sequencing at least a portion of the nucleotide sequence of the SOS2 genomic nucleic acid molecule, the SOS2 mRNA molecule, or the SOS2 cDNA molecule in the biological sample, wherein the sequenced portion comprises one or more variations that cause a loss-of-function (partial or complete) or are predicted to cause a loss-of-function (partial or complete).

In some embodiments, the determining step, detecting step, or genotyping assay comprises sequencing at least a portion of: the nucleotide sequence of the SOS2 genomic nucleic acid molecule in the biological sample, wherein the sequenced portion comprises a position corresponding to position 42,940 according to SEQ ID NO:2, or the complement thereof; the nucleotide sequence of the SOS2 mRNA molecule in the biological sample, wherein the sequenced portion comprises a position corresponding to position 598 according to SEQ ID NO:12, or the complement thereof; position 598 according to SEQ ID NO:14, or the complement thereof; position 598 according to SEQ ID NO:16, or the complement thereof; position 572 according to SEQ ID NO:18, or the complement thereof; position 591 according to SEQ ID NO:20, or the complement thereof; position 640 according to SEQ ID NO:22, or the complement thereof; position 581 according to SEQ ID NO:24, or the complement thereof; or position 662 according to SEQ ID NO:26, or the complement thereof; and/or the nucleotide sequence of the SOS2 cDNA molecule produced from the mRNA in the biological sample, wherein the sequenced portion comprises a position corresponding to position 598 according to SEQ ID NO:36, or the complement thereof; position 598 according to SEQ ID NO:38, or the complement thereof; position 598 according to SEQ ID NO:40, or the complement thereof; position 572 according to SEQ ID NO:42, or the complement thereof; position 591 according to SEQ ID NO:44, or the complement thereof; position 640 according to SEQ ID NO:46, or the complement thereof; position 581 according to SEQ ID NO:48, or the complement thereof; or position 662 according to SEQ ID NO:50, or the complement thereof. When the sequenced portion of the SOS2 nucleic acid molecule in the biological sample comprises: a guanine at a position corresponding to position 42,940 according to SEQ ID NO:2, a guanine at a position corresponding to position 598 according to SEQ ID NO:12, a guanine at a position corresponding to position 598 according to SEQ ID NO:14, a guanine at a position corresponding to position 598 according to SEQ ID NO:16, a guanine at a position corresponding to position 572 according to SEQ ID NO:18, a guanine at a position corresponding to position 591 according to SEQ ID NO:20, a guanine at a position corresponding to position 640 according to SEQ ID NO:22, a guanine at a position corresponding to position 581 according to SEQ ID NO:24, or a guanine at a position corresponding to position 662 according to SEQ ID NO:26, or a guanine at a position corresponding to position 598 according to SEQ ID NO:36, a guanine at a position corresponding to position 598 according to SEQ ID NO:38, a guanine at a position corresponding to position 598 according to SEQ ID NO:40, a guanine at a position corresponding to position 572 according to SEQ ID NO:42, a guanine at a position corresponding to position 591 according to SEQ ID NO:44, a guanine at a position corresponding to position 640 according to SEQ ID NO:46, a guanine at a position corresponding to position 581 according to SEQ ID NO:48, or a guanine at a position corresponding to position 662 according to SEQ ID NO:50, then the SOS2 nucleic acid molecule in the biological sample is an SOS2 predicted loss-of-function variant nucleic acid molecule.

In some embodiments, the determining step, detecting step, or genotyping assay comprises sequencing at least a portion of: the nucleotide sequence of the SOS2 genomic nucleic acid molecule in the biological sample, wherein the sequenced portion comprises a position corresponding to position 42,990 according to SEQ ID NO:3, or the complement thereof; the nucleotide sequence of the SOS2 mRNA molecule in the biological sample, wherein the sequenced portion comprises a position corresponding to position 648 according to SEQ ID NO:13, or the complement thereof; position 648 according to SEQ ID NO:15, or the complement thereof; position 648 according to SEQ ID NO:17, or the complement thereof; position 622 according to SEQ ID NO:19, or the complement thereof; position 641 according to SEQ ID NO:21, or the complement thereof; position 690 according to SEQ ID NO:23, or the complement thereof; position 631 according to SEQ ID NO:25, or the complement thereof; or position 712 according to SEQ ID NO:27, or the complement thereof; and/or the nucleotide sequence of the SOS2 cDNA molecule produced from the mRNA in the biological sample, wherein the sequenced portion comprises a position corresponding to position 648 according to SEQ ID NO:37, or the complement thereof; position 648 according to SEQ ID NO:39, or the complement thereof; position 648 according to SEQ ID NO:41, or the complement thereof; position 622 according to SEQ ID NO:43, or the complement thereof; position 641 according to SEQ ID NO:45, or the complement thereof; position 690 according to SEQ ID NO:47, or the complement thereof; position 631 according to SEQ ID NO:49, or the complement thereof; position 712 according to SEQ ID NO:51, or the complement thereof. When the sequenced portion of the SOS2 nucleic acid molecule in the biological sample comprises: an adenine at a position corresponding to position 42,990 according to SEQ ID NO:3, an adenine at a position corresponding to position 648 according to SEQ ID NO:13, an adenine at a position corresponding to position 648 according to SEQ ID NO:15, an adenine at a position corresponding to position 648 according to SEQ ID NO:17, an adenine at a position corresponding to position 622 according to SEQ ID NO:19, an adenine at a position corresponding to position 641 according to SEQ ID NO:21, an adenine at a position corresponding to position 690 according to SEQ ID NO:23, an adenine at a position corresponding to position 631 according to SEQ ID NO:25, or an adenine at a position corresponding to position 712 according to SEQ ID NO:27, or an adenine at a position corresponding to position 648 according to SEQ ID NO:37, an adenine at a position corresponding to position 648 according to SEQ ID NO:39, an adenine at a position corresponding to position 648 according to SEQ ID NO:41, an adenine at a position corresponding to position 622 according to SEQ ID NO:43, an adenine at a position corresponding to position 641 according to SEQ ID NO:45, an adenine at a position corresponding to position 690 according to SEQ ID NO:47, an adenine at a position corresponding to position 631 according to SEQ ID NO:49, or an adenine at a position corresponding to position 712 according to SEQ ID NO:51, then the SOS2 nucleic acid molecule in the biological sample is an SOS2 predicted loss-of-function variant nucleic acid molecule.

In some embodiments, the determining step, detecting step, or genotyping assay comprises sequencing at least a portion of the nucleotide sequence of the SOS2 genomic nucleic acid molecule in the biological sample, wherein the sequenced portion comprises a position corresponding to: position 42,940 according to SEQ ID NO:2, or the complement thereof; or position 42,990 according to SEQ ID NO:3, or the complement thereof. When the sequenced portion of the SOS2 nucleic acid molecule in the biological sample comprises: a guanine at a position corresponding to position 42,940 according to SEQ ID NO:2, or an adenine at a position corresponding to position 42,990 according to SEQ ID NO:3, then the SOS2 nucleic acid molecule in the biological sample is an SOS2 predicted loss-of-function variant nucleic acid molecule.

In some embodiments, the determining step, detecting step, or genotyping assay comprises sequencing at least a portion of the nucleotide sequence of the SOS2 mRNA molecule in the biological sample, wherein the sequenced portion comprises a position corresponding to: position 598 according to SEQ ID NO:12, or the complement thereof; position 598 according to SEQ ID NO:14, or the complement thereof; position 598 according to SEQ ID NO:16, or the complement thereof; position 572 according to SEQ ID NO:18, or the complement thereof; position 591 according to SEQ ID NO:20, or the complement thereof; position 640 according to SEQ ID NO:22, or the complement thereof; position 581 according to SEQ ID NO:24, or the complement thereof; or position 662 according to SEQ ID NO:26, or the complement thereof; position 648 according to SEQ ID NO:13, or the complement thereof; position 648 according to SEQ ID NO:15, or the complement thereof; position 648 according to SEQ ID NO:17, or the complement thereof; position 622 according to SEQ ID NO:19, or the complement thereof; position 641 according to SEQ ID NO:21, or the complement thereof; position 690 according to SEQ ID NO:23, or the complement thereof; position 631 according to SEQ ID NO:25, or the complement thereof; or position 712 according to SEQ ID NO:27, or the complement thereof. When the sequenced portion of the SOS2 nucleic acid molecule in the biological sample comprises: a guanine at a position corresponding to position 598 according to SEQ ID NO:12, a guanine at a position corresponding to position 598 according to SEQ ID NO:14, a guanine at a position corresponding to position 598 according to SEQ ID NO:16, a guanine at a position corresponding to position 572 according to SEQ ID NO:18, a guanine at a position corresponding to position 591 according to SEQ ID NO:20, a guanine at a position corresponding to position 640 according to SEQ ID NO:22, a guanine at a position corresponding to position 581 according to SEQ ID NO:24, or a guanine at a position corresponding to position 662 according to SEQ ID NO:26; an adenine at a position corresponding to position 648 according to SEQ ID NO:13, an adenine at a position corresponding to position 648 according to SEQ ID NO:15, an adenine at a position corresponding to position 648 according to SEQ ID NO:17, an adenine at a position corresponding to position 622 according to SEQ ID NO:19, an adenine at a position corresponding to position 641 according to SEQ ID NO:21, an adenine at a position corresponding to position 690 according to SEQ ID NO:23, an adenine at a position corresponding to position 631 according to SEQ ID NO:25, or an adenine at a position corresponding to position 712 according to SEQ ID NO:27; then the SOS2 nucleic acid molecule in the biological sample is an SOS2 predicted loss-of-function variant nucleic acid molecule.

In some embodiments, the determining step, detecting step, or genotyping assay comprises sequencing at least a portion of the nucleotide sequence of the SOS2 cDNA molecule in the biological sample, wherein the sequenced portion comprises a position corresponding to: position 598 according to SEQ ID NO:36, or the complement thereof; position 598 according to SEQ ID NO:38, or the complement thereof; position 598 according to SEQ ID NO:40, or the complement thereof; position 572 according to SEQ ID NO:42, or the complement thereof; position 591 according to SEQ ID NO:44, or the complement thereof; position 640 according to SEQ ID NO:46, or the complement thereof; position 581 according to SEQ ID NO:48, or the complement thereof; or position 662 according to SEQ ID NO:50, or the complement thereof; position 648 according to SEQ ID NO:37, or the complement thereof; position 648 according to SEQ ID NO:39, or the complement thereof; position 648 according to SEQ ID NO:41, or the complement thereof; position 622 according to SEQ ID NO:43, or the complement thereof; position 641 according to SEQ ID NO:45, or the complement thereof; position 690 according to SEQ ID NO:47, or the complement thereof; position 631 according to SEQ ID NO:49, or the complement thereof; position 712 according to SEQ ID NO:51, or the complement thereof. When the sequenced portion of the SOS2 nucleic acid molecule in the biological sample comprises: a guanine at a position corresponding to position 598 according to SEQ ID NO:36, a guanine at a position corresponding to position 598 according to SEQ ID NO:38, a guanine at a position corresponding to position 598 according to SEQ ID NO:40, a guanine at a position corresponding to position 572 according to SEQ ID NO:42, a guanine at a position corresponding to position 591 according to SEQ ID NO:44, a guanine at a position corresponding to position 640 according to SEQ ID NO:46, a guanine at a position corresponding to position 581 according to SEQ ID NO:48, or a guanine at a position corresponding to position 662 according to SEQ ID NO:50; an adenine at a position corresponding to position 648 according to SEQ ID NO:37, an adenine at a position corresponding to position 648 according to SEQ ID NO:39, an adenine at a position corresponding to position 648 according to SEQ ID NO:41, an adenine at a position corresponding to position 622 according to SEQ ID NO:43, an adenine at a position corresponding to position 641 according to SEQ ID NO:45, an adenine at a position corresponding to position 690 according to SEQ ID NO:47, an adenine at a position corresponding to position 631 according to SEQ ID NO:49, or an adenine at a position corresponding to position 712 according to SEQ ID NO:51; then the SOS2 nucleic acid molecule in the biological sample is an SOS2 predicted loss-of-function variant nucleic acid molecule.

In some embodiments, the determining step, detecting step, or genotyping assay comprises: a) contacting the biological sample with a primer hybridizing to a portion of the nucleotide sequence of the SOS2: genomic nucleic acid molecule that is proximate to a position corresponding to position 42,940 according to SEQ ID NO:2, or the complement thereof; mRNA molecule that is proximate to a position corresponding to position 598 according to SEQ ID NO:12, or the complement thereof; position 598 according to SEQ ID NO:14, or the complement thereof; position 598 according to SEQ ID NO:16, or the complement thereof; position 572 according to SEQ ID NO:18, or the complement thereof; position 591 according to SEQ ID NO:20, or the complement thereof; position 640 according to SEQ ID NO:22, or the complement thereof; position 581 according to SEQ ID NO:24, or the complement thereof; or position 662 according to SEQ ID NO:26, or the complement thereof; and/or cDNA molecule that is proximate to a position corresponding to position 598 according to SEQ ID NO:36, or the complement thereof; position 598 according to SEQ ID NO:38, or the complement thereof; position 598 according to SEQ ID NO:40, or the complement thereof; position 572 according to SEQ ID NO:42, or the complement thereof; position 591 according to SEQ ID NO:44, or the complement thereof; position 640 according to SEQ ID NO:46, or the complement thereof; position 581 according to SEQ ID NO:48, or the complement thereof; or position 662 according to SEQ ID NO:50, or the complement thereof; b) extending the primer at least through the position of the nucleotide sequence of the SOS2: genomic nucleic acid molecule corresponding to position 42,940 according to SEQ ID NO:2; mRNA molecule corresponding to position 598 according to SEQ ID NO:12, position 598 according to SEQ ID NO:14, position 598 according to SEQ ID NO:16, position 572 according to SEQ ID NO:18, position 591 according to SEQ ID NO:20, position 640 according to SEQ ID NO:22, position 581 according to SEQ ID NO:24, or position 662 according to SEQ ID NO:26; and/or cDNA molecule corresponding to position 598 according to SEQ ID NO:36, position 598 according to SEQ ID NO:38, position 598 according to SEQ ID NO:40, position 572 according to SEQ ID NO:42, position 591 according to SEQ ID NO:44, position 640 according to SEQ ID NO:46, position 581 according to SEQ ID NO:48, or position 662 according to SEQ ID NO:50; and c) determining whether the extension product of the primer comprises: a guanine at a position corresponding to position 42,940 according to SEQ ID NO:2; a guanine at a position corresponding to position 598 according to SEQ ID NO:12, a guanine at a position corresponding to position 598 according to SEQ ID NO:14, a guanine at a position corresponding to position 598 according to SEQ ID NO:16, a guanine at a position corresponding to position 572 according to SEQ ID NO:18, a guanine at a position corresponding to position 591 according to SEQ ID NO:20, a guanine at a position corresponding to position 640 according to SEQ ID NO:22, a guanine at a position corresponding to position 581 according to SEQ ID NO:24, or a guanine at a position corresponding to position 662 according to SEQ ID NO:26;

and/or a guanine at a position corresponding to position 598 according to SEQ ID NO:36, a guanine at a position corresponding to position 598 according to SEQ ID NO:38, a guanine at a position corresponding to position 598 according to SEQ ID NO:40, a guanine at a position corresponding to position 572 according to SEQ ID NO:42, a guanine at a position corresponding to position 591 according to SEQ ID NO:44, a guanine at a position corresponding to position 640 according to SEQ ID NO:46, a guanine at a position corresponding to position 581 according to SEQ ID NO:48, or a guanine at a position corresponding to position 662 according to SEQ ID NO:50.

In some embodiments, the determining step, detecting step, or genotyping assay comprises: a) contacting the biological sample with a primer hybridizing to a portion of the nucleotide sequence of the SOS2: genomic nucleic acid molecule that is proximate to a position corresponding to position 42,990 according to SEQ ID NO:3, or the complement thereof; mRNA molecule that is proximate to a position corresponding to position 648 according to SEQ ID NO:13, position 648 according to SEQ ID NO:15, position 648 according to SEQ ID NO:17, position 622 according to SEQ ID NO:19, position 641 according to SEQ ID NO:21, position 690 according to SEQ ID NO:23, position 631 according to SEQ ID NO:25, or position 712 according to SEQ ID NO:27; and/or cDNA molecule that is proximate to a position corresponding to position 648 according to SEQ ID NO:37, position 648 according to SEQ ID NO:39, position 648 according to SEQ ID NO:41, position 622 according to SEQ ID NO:43, position 641 according to SEQ ID NO:45, position 690 according to SEQ ID NO:47, position 631 according to SEQ ID NO:49, or position 712 according to SEQ ID NO:51; b) extending the primer at least through the position of the nucleotide sequence of the SOS2: genomic nucleic acid molecule corresponding to position 42,990 according to SEQ ID NO:3, or the complement thereof; mRNA molecule corresponding to position 648 according to SEQ ID NO:13, position 648 according to SEQ ID NO:15, position 648 according to SEQ ID NO:17, position 622 according to SEQ ID NO:19, position 641 according to SEQ ID NO:21, position 690 according to SEQ ID NO:23, position 631 according to SEQ ID NO:25, or position 712 according to SEQ ID NO:27; and/or cDNA molecule corresponding to position 648 according to SEQ ID NO:37, position 648 according to SEQ ID NO:39, position 648 according to SEQ ID NO:41, position 622 according to SEQ ID NO:43, position 641 according to SEQ ID NO:45, position 690 according to SEQ ID NO:47, position 631 according to SEQ ID NO:49, or position 712 according to SEQ ID NO:51; and c) determining whether the extension product of the primer comprises: an adenine at a position corresponding to position 42,990 according to SEQ ID NO:3; an adenine at a position corresponding to position 648 according to SEQ ID NO:13, an adenine at a position corresponding to position 648 according to SEQ ID NO:15, an adenine at a position corresponding to position 648 according to SEQ ID NO:17, an adenine at a position corresponding to position 622 according to SEQ ID NO:19, an adenine at a position corresponding to position 641 according to SEQ ID NO:21, an adenine at a position corresponding to position 690 according to SEQ ID NO:23, an adenine at a position corresponding to position 631 according to SEQ ID NO:25, or an adenine at a position corresponding to position 712 according to SEQ ID NO:27; and/or an adenine at a position corresponding to position 648 according to SEQ ID NO:37, an adenine at a position corresponding to position 648 according to SEQ ID NO:39, an adenine at a position corresponding to position 648 according to SEQ ID NO:41, an adenine at a position corresponding to position 622 according to SEQ ID NO:43, an adenine at a position corresponding to position 641 according to SEQ ID NO:45, an adenine at a position corresponding to position 690 according to SEQ ID NO:47, an adenine at a position corresponding to position 631 according to SEQ ID NO:49, or an adenine at a position corresponding to position 712 according to SEQ ID NO:51.

In some embodiments, the determining step, detecting step, or genotyping assay comprises: a) contacting the biological sample with a primer hybridizing to a portion of the nucleotide sequence of the SOS2 genomic nucleic acid molecule that is proximate to a position corresponding to position 42,940 according to SEQ ID NO:2, or position 42,990 according to SEQ ID NO:3; b) extending the primer at least through the position of the nucleotide sequence of the SOS2 genomic nucleic acid molecule corresponding to position 42,940 according to SEQ ID NO:2, or position 42,990 according to SEQ ID NO:3; and c) determining whether the extension product of the primer comprises a guanine at a position corresponding to position 42,940 according to SEQ ID NO:2, or an adenine at a position corresponding to position 42,990 according to SEQ ID NO:3.

In some embodiments, the determining step, detecting step, or genotyping assay comprises: a) contacting the biological sample with a primer hybridizing to a portion of the nucleotide sequence of the SOS2 mRNA molecule that is proximate to a position corresponding to: position 598 according to SEQ ID NO:12, position 598 according to SEQ ID NO:14, position 598 according to SEQ ID NO:16, position 572 according to SEQ ID NO:18, position 591 according to SEQ ID NO:20, position 640 according to SEQ ID NO:22, position 581 according to SEQ ID NO:24, or position 662 according to SEQ ID NO:26; position 648 according to SEQ ID NO:13, position 648 according to SEQ ID NO:15, position 648 according to SEQ ID NO:17, position 622 according to SEQ ID NO:19, position 641 according to SEQ ID NO:21, position 690 according to SEQ ID NO:23, position 631 according to SEQ ID NO:25, or position 712 according to SEQ ID NO:27; b) extending the primer at least through the position of the nucleotide sequence of the SOS2 mRNA molecule corresponding to: position 598 according to SEQ ID NO:12, position 598 according to SEQ ID NO:14, position 598 according to SEQ ID NO:16, position 572 according to SEQ ID NO:18, position 591 according to SEQ ID NO:20, position 640 according to SEQ ID NO:22, position 581 according to SEQ ID NO:24, or position 662 according to SEQ ID NO:26; position 648 according to SEQ ID NO:13, position 648 according to SEQ ID NO:15, position 648 according to SEQ ID NO:17, position 622 according to SEQ ID NO:19, position 641 according to SEQ ID NO:21, position 690 according to SEQ ID NO:23, position 631 according to SEQ ID NO:25, or position 712 according to SEQ ID NO:27; and c) determining whether the extension product of the primer comprises: a guanine at a position corresponding to position 598 according to SEQ ID NO:12, a guanine at a position corresponding to position 598 according to SEQ ID NO:14, a guanine at a position corresponding to position 598 according to SEQ ID NO:16, a guanine at a position corresponding to position 572 according to SEQ ID NO:18, a guanine at a position corresponding to position 591 according to SEQ ID NO:20, a guanine at a position corresponding to position 640 according to SEQ ID NO:22, a guanine at a position corresponding to position 581 according to SEQ ID NO:24, or a guanine at a position corresponding to position 662 according to SEQ ID NO:26; an adenine at a position corresponding to position 648 according to SEQ ID NO:13, an adenine at a position corresponding to position 648 according to SEQ ID NO:15, an adenine at a position corresponding to position 648 according to SEQ ID NO:17, an adenine at a position corresponding to position 622 according to SEQ ID NO:19, an adenine at a position corresponding to position 641 according to SEQ ID NO:21, an adenine at a position corresponding to position 690 according to SEQ ID NO:23, an adenine at a position corresponding to position 631 according to SEQ ID NO:25, or an adenine at a position corresponding to position 712 according to SEQ ID NO:27.

In some embodiments, the determining step, detecting step, or genotyping assay comprises: a) contacting the biological sample with a primer hybridizing to a portion of the nucleotide sequence of the SOS2 cDNA molecule that is proximate to a position corresponding to: position 598 according to SEQ ID NO:36, position 598 according to SEQ ID NO:38, position 598 according to SEQ ID NO:40, position 572 according to SEQ ID NO:42, position 591 according to SEQ ID NO:44, position 640 according to SEQ ID NO:46, position 581 according to SEQ ID NO:48, or position 662 according to SEQ ID NO:50; or position 648 according to SEQ ID NO:37, position 648 according to SEQ ID NO:39, position 648 according to SEQ ID NO:41, position 622 according to SEQ ID NO:43, position 641 according to SEQ ID NO:45, position 690 according to SEQ ID NO:47, position 631 according to SEQ ID NO:49, or position 712 according to SEQ ID NO:51; b) extending the primer at least through the position of the nucleotide sequence of the SOS2 cDNA molecule corresponding to: position 598 according to SEQ ID NO:36, position 598 according to SEQ ID NO:38, position 598 according to SEQ ID NO:40, position 572 according to SEQ ID NO:42, position 591 according to SEQ ID NO:44, position 640 according to SEQ ID NO:46, position 581 according to SEQ ID NO:48, or position 662 according to SEQ ID NO:50; or position 648 according to SEQ ID NO:37, position 648 according to SEQ ID NO:39, position 648 according to SEQ ID NO:41, position 622 according to SEQ ID NO:43, position 641 according to SEQ ID NO:45, position 690 according to SEQ ID NO:47, position 631 according to SEQ ID NO:49, or position 712 according to SEQ ID NO:51; and c) determining whether the extension product of the primer comprises: a guanine at a position corresponding to position 598 according to SEQ ID NO:36, a guanine at a position corresponding to position 598 according to SEQ ID NO:38, a guanine at a position corresponding to position 598 according to SEQ ID NO:40, a guanine at a position corresponding to position 572 according to SEQ ID NO:42, a guanine at a position corresponding to position 591 according to SEQ ID NO:44, a guanine at a position corresponding to position 640 according to SEQ ID NO:46, a guanine at a position corresponding to position 581 according to SEQ ID NO:48, or a guanine at a position corresponding to position 662 according to SEQ ID NO:50; or an adenine at a position corresponding to position 648 according to SEQ ID NO:37, an adenine at a position corresponding to position 648 according to SEQ ID NO:39, an adenine at a position corresponding to position 648 according to SEQ ID NO:41, an adenine at a position corresponding to position 622 according to SEQ ID NO:43, an adenine at a position corresponding to position 641 according to SEQ ID NO:45, an adenine at a position corresponding to position 690 according to SEQ ID NO:47, an adenine at a position corresponding to position 631 according to SEQ ID NO:49, or an adenine at a position corresponding to position 712 according to SEQ ID NO:51.

In some embodiments, the assay comprises sequencing the entire nucleic acid molecule. In some embodiments, only an SOS2 genomic nucleic acid molecule is analyzed. In some embodiments, only an SOS2 mRNA is analyzed. In some embodiments, only an SOS2 cDNA obtained from SOS2 mRNA is analyzed.

In some embodiments, the determining step, detecting step, or genotyping assay comprises: a) amplifying at least a portion of the nucleic acid molecule that encodes the human SOS2 polypeptide, wherein the amplified portion comprises: i) a guanine at a position corresponding to position 42,940 according to SEQ ID NO:2, or the complement thereof; ii) a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; and/or iii) a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: i) a guanine at a position corresponding to position 42,940 according to SEQ ID NO:2, or the complement thereof; ii) a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; and/or iii) a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50, or the complement thereof; and d) detecting the detectable label.

In some embodiments, the determining step, detecting step, or genotyping assay comprises: a) amplifying at least a portion of the nucleic acid molecule that encodes the human SOS2 polypeptide, wherein the amplified portion comprises: i) an adenine at a position corresponding to position 42,990 according to SEQ ID NO:3, or the complement thereof; ii) an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; and/or iii) an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: i) an adenine at a position corresponding to position 42,990 according to SEQ ID NO:3, or the complement thereof; ii) an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; and/or iii) an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof; and d) detecting the detectable label.

In some embodiments, the determining step, detecting step, or genotyping assay comprises: a) amplifying at least a portion of the nucleic acid molecule that encodes the human SOS2 polypeptide, wherein the amplified portion comprises: a guanine at a position corresponding to position 42,940 according to SEQ ID NO:2, or the complement thereof; or an adenine at a position corresponding to position 42,990 according to SEQ ID NO:3, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: a guanine at a position corresponding to position 42,940 according to SEQ ID NO:2, or the complement thereof; an adenine at a position corresponding to position 42,990 according to SEQ ID NO:3, or the complement thereof; and d) detecting the detectable label.

In some embodiments, the determining step, detecting step, or genotyping assay comprises: a) amplifying at least a portion of the nucleic acid molecule that encodes the human SOS2 polypeptide, wherein the amplified portion comprises: a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: a guanine at a position corresponding to position 42,940 according to SEQ ID NO:2, or the complement thereof; ii) a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; and d) detecting the detectable label.

In some embodiments, the determining step, detecting step, or genotyping assay comprises: a) amplifying at least a portion of the nucleic acid molecule that encodes the human SOS2 polypeptide, wherein the amplified portion comprises: a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50, or the complement thereof; an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50, or the complement thereof; an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof; and d) detecting the detectable label.

In some embodiments, the nucleic acid molecule is mRNA and the determining step further comprises reverse-transcribing the mRNA into a cDNA prior to the amplifying step.

In some embodiments, the determining step, detecting step, or genotyping assay comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: i) a guanine at a position corresponding to position 42,940 according to SEQ ID NO:2, or the complement thereof; ii) a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; and/or iii) a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50, or the complement thereof; and detecting the detectable label.

In some embodiments, the determining step, detecting step, or genotyping assay comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: i) an adenine at a position corresponding to position 42,990 according to SEQ ID NO:3, or the complement thereof; ii) an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; and/or iii) an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof; and detecting the detectable label.

In some embodiments, the determining step, detecting step, or genotyping assay comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: a guanine at a position corresponding to position 42,940 according to SEQ ID NO:2, or the complement thereof; or an adenine at a position corresponding to position 42,990 according to SEQ ID NO:3, or the complement thereof; and detecting the detectable label.

In some embodiments, the determining step, detecting step, or genotyping assay comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; and detecting the detectable label.

In some embodiments, the determining step, detecting step, or genotyping assay comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50, or the complement thereof; an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof; and detecting the detectable label.

Alteration-specific polymerase chain reaction techniques can be used to detect mutations such as SNPs in a nucleic acid sequence. Alteration-specific primers can be used because the DNA polymerase will not extend when a mismatch with the template is present.

In some embodiments, the nucleic acid molecule in the sample is mRNA and the mRNA is reverse-transcribed into a cDNA prior to the amplifying step. In some embodiments, the nucleic acid molecule is present within a cell obtained from the human subject.

In some embodiments, the assay comprises contacting the biological sample with a primer or probe, such as an alteration-specific primer or alteration-specific probe, that specifically hybridizes to an SOS2 variant genomic sequence, variant mRNA sequence, or variant cDNA sequence and not the corresponding SOS2 reference sequence under stringent conditions, and determining whether hybridization has occurred.

In some embodiments, the assay comprises RNA sequencing (RNA-Seq). In some embodiments, the assays also comprise reverse transcribing mRNA into cDNA, such as by the reverse transcriptase polymerase chain reaction (RT-PCR).

In some embodiments, the methods utilize probes and primers of sufficient nucleotide length to bind to the target nucleotide sequence and specifically detect and/or identify a polynucleotide comprising an SOS2 variant genomic nucleic acid molecule, variant mRNA molecule, or variant cDNA molecule. The hybridization conditions or reaction conditions can be determined by the operator to achieve this result. The nucleotide length may be any length that is sufficient for use in a detection method of choice, including any assay described or exemplified herein. Such probes and primers can hybridize specifically to a target nucleotide sequence under high stringency hybridization conditions. Probes and primers may have complete nucleotide sequence identity of contiguous nucleotides within the target nucleotide sequence, although probes differing from the target nucleotide sequence and that retain the ability to specifically detect and/or identify a target nucleotide sequence may be designed by conventional methods. Probes and primers can have about 80%, about 85%, about 90%, about 91%, about 92%, about 93%, about 94%, about 95%, about 96%, about 97%, about 98%, about 99%, or 100% sequence identity or complementarity with the nucleotide sequence of the target nucleic acid molecule.

In some embodiments, to determine whether an SOS2 nucleic acid molecule (genomic nucleic acid molecule, mRNA molecule, or cDNA molecule), or complement thereof, within a biological sample comprises a nucleotide sequence comprising a guanine at a position corresponding to position 42,940 according to SEQ ID NO:2 (genomic nucleic acid molecule), or a guanine at a position corresponding to position 598 according to SEQ ID NO:12, a guanine at a position corresponding to position 598 according to SEQ ID NO:14, a guanine at a position corresponding to position 598 according to SEQ ID NO:16, a guanine at a position corresponding to position 572 according to SEQ ID NO:18, a guanine at a position corresponding to position 591 according to SEQ ID NO:20, a guanine at a position corresponding to position 640 according to SEQ ID NO:22, a guanine at a position corresponding to position 581 according to SEQ ID NO:24, or a guanine at a position corresponding to position 662 according to SEQ ID NO:26 (mRNA molecule), or a guanine at a position corresponding to position 598 according to SEQ ID NO:36, a guanine at a position corresponding to position 598 according to SEQ ID NO:38, a guanine at a position corresponding to position 598 according to SEQ ID NO:40, a guanine at a position corresponding to position 572 according to SEQ ID NO:42, a guanine at a position corresponding to position 591 according to SEQ ID NO:44, a guanine at a position corresponding to position 640 according to SEQ ID NO:46, a guanine at a position corresponding to position 581 according to SEQ ID NO:48, or a guanine at a position corresponding to position 662 according to SEQ ID NO:50 (cDNA molecule), the biological sample can be subjected to an amplification method using a primer pair that includes a first primer derived from the 5' flanking sequence adjacent to a guanine at a position corresponding to position 42,940 according to SEQ ID NO:2 (genomic nucleic acid molecule), or a guanine at a position corresponding to position 598 according to SEQ ID NO:12, a guanine at a position corresponding to position 598 according to SEQ ID NO:14, a guanine at a position corresponding to position 598 according to SEQ ID NO:16, a guanine at a position corresponding to position 572 according to SEQ ID NO:18, a guanine at a position corresponding to position 591 according to SEQ ID NO:20, a guanine at a position corresponding to position 640 according to SEQ ID NO:22, a guanine at a position corresponding to position 581 according to SEQ ID NO:24, or a guanine at a position corresponding to position 662 according to SEQ ID NO:26 (mRNA molecule), or a guanine at a position corresponding to position 598 according to SEQ ID NO:36, a guanine at a position corresponding to position 598 according to SEQ ID NO:38, a guanine at a position corresponding to position 598 according to SEQ ID NO:40, a guanine at a position corresponding to position 572 according to SEQ ID NO:42, a guanine at a position corresponding to position 591 according to SEQ ID NO:44, a guanine at a position corresponding to position 640 according to SEQ ID NO:46, a guanine at a position corresponding to position 581 according to SEQ ID NO:48, or a guanine at a position corresponding to position 662 according to SEQ ID NO:50 (cDNA molecule), and a second primer derived from the 3' flanking sequence adjacent to a guanine at a position corresponding to position 42,940 according to SEQ ID NO:2 (genomic nucleic acid molecule), or a guanine at a position corresponding to position 598 according to SEQ ID NO:12, a guanine at a position corresponding to position 598 according to SEQ ID NO:14, a guanine at a position corresponding to position 598 according to SEQ ID NO:16, a guanine at a position corresponding to position 572 according to SEQ ID NO:18, a guanine at a position corresponding to position 591 according to SEQ ID NO:20, a guanine at a position corresponding to position 640 according to SEQ ID NO:22, a guanine at a position corresponding to position 581 according to SEQ ID NO:24, or a guanine at a position corresponding to position 662 according to SEQ ID NO:26 (mRNA molecule), or a guanine at a position corresponding to position 598 according to SEQ ID NO:36, a guanine at a position corresponding to position 598 according to SEQ ID NO:38, a guanine at a position corresponding to position 598 according to SEQ ID NO:40, a guanine at a position corresponding to position 572 according to SEQ ID NO:42, a guanine at a position corresponding to position 591 according to SEQ ID NO:44, a guanine at a position corresponding to position 640 according to SEQ ID NO:46, a guanine at a position corresponding to position 581 according to SEQ ID NO:48, or a guanine at a position corresponding to position 662 according to SEQ ID NO:50 (cDNA molecule) to produce an amplicon that is indicative of the presence of the SNP at positions encoding a guanine at a position corresponding to position 42,940 according to SEQ ID NO:2 (genomic nucleic acid molecule), or a guanine at a position corresponding to position 598 according to SEQ ID NO:12, a guanine at a position corresponding to position 598 according to SEQ ID NO:14, a guanine at a position corresponding to position 598 according to SEQ ID NO:16, a guanine at a position corresponding to position 572 according to SEQ ID NO:18, a guanine at a position corresponding to position 591 according to SEQ ID NO:20, a guanine at a position corresponding to position 640 according to SEQ ID NO:22, a guanine at a position corresponding to position 581 according to SEQ ID NO:24, or a guanine at a position corresponding to position 662 according to SEQ ID NO:26 (mRNA molecule), or a guanine at a position corresponding to position 598 according to SEQ ID NO:36, a guanine at a position corresponding to position 598 according to SEQ ID NO:38, a guanine at a position corresponding to position 598 according to SEQ ID NO:40, a guanine at a position corresponding to position 572 according to SEQ ID NO:42, a guanine at a position corresponding to position 591 according to SEQ ID NO:44, a guanine at a position corresponding to position 640 according to SEQ ID NO:46, a guanine at a position corresponding to position 581 according to SEQ ID NO:48, or a guanine at a position corresponding to position 662 according to SEQ ID NO:50 (cDNA molecule). In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions comprising a guanine at a position corresponding to position 42,940 according to SEQ ID NO:2 (genomic nucleic acid molecule), or a guanine at a position corresponding to position 598 according to SEQ ID NO:12, a guanine at a position corresponding to position 598 according to SEQ ID NO:14, a guanine at a position corresponding to position 598 according to SEQ ID NO:16, a guanine at a position corresponding to position 572 according to SEQ ID NO:18, a guanine at a position corresponding to position 591 according to SEQ ID NO:20, a guanine at a position corresponding to position 640 according to SEQ ID NO:22, a guanine at a position corresponding to position 581 according to SEQ ID NO:24, or a guanine at a position corresponding to position 662 according to SEQ ID NO:26 (mRNA molecule), or a guanine at a position corresponding to position 598 according to SEQ ID NO:36, a guanine at a position corresponding to position 598 according to SEQ ID NO:38, a guanine at a position corresponding to position 598 according to SEQ ID NO:40, a guanine at a position corresponding to position 572 according to SEQ ID NO:42, a guanine at a position corresponding to position 591 according to SEQ ID NO:44, a guanine at a position corresponding to position 640 according to SEQ ID NO:46, a guanine at a position corresponding to position 581 according to SEQ ID NO:48, or a guanine at a position corresponding to position 662 according to SEQ ID NO:50 (cDNA molecule), and at least 1, 2, 3, 4, 5, 6, 7, 8, 9, 10, or more nucleotides on each side of positions comprising a guanine at a position corresponding to position 42,940 according to SEQ ID NO:2 (genomic nucleic acid molecule), or a guanine at a position corresponding to position 598 according to SEQ ID NO:12, a guanine at a position corresponding to position 598 according to SEQ ID NO:14, a guanine at a position corresponding to position 598 according to SEQ ID NO:16, a guanine at a position corresponding to position 572 according to SEQ ID NO:18, a guanine at a position corresponding to position 591 according to SEQ ID NO:20, a guanine at a position corresponding to position 640 according to SEQ ID NO:22, a guanine at a position corresponding to position 581 according to SEQ ID NO:24, or a guanine at a position corresponding to position 662 according to SEQ ID NO:26 (mRNA molecule), or a guanine at a position corresponding to position 598 according to SEQ ID NO:36, a guanine at a position corresponding to position 598 according to SEQ ID NO:38, a guanine at a position corresponding to position 598 according to SEQ ID NO:40, a guanine at a position corresponding to position 572 according to SEQ ID NO:42, a guanine at a position corresponding to position 591 according to SEQ ID NO:44, a guanine at a position corresponding to position 640 according to SEQ ID NO:46, a guanine at a position corresponding to position 581 according to SEQ ID NO:48, or a guanine at a position corresponding to position 662 according to SEQ ID NO:50 (cDNA molecule).

In some embodiments, to determine whether an SOS2 nucleic acid molecule (genomic nucleic acid molecule, mRNA molecule, or cDNA molecule), or complement thereof, within a biological sample comprises a nucleotide sequence comprising an adenine at a position corresponding to position 42,990 according to SEQ ID NO:3 (genomic nucleic acid molecule), or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27 (mRNA molecule), or an adenine at a position corresponding to position 648 according to SEQ ID NO:37, an adenine at a position corresponding to position 648 according to SEQ ID NO:39, an adenine at a position corresponding to position 648 according to SEQ ID NO:41, an adenine at a position corresponding to position 622 according to SEQ ID NO:43, an adenine at a position corresponding to position 641 according to SEQ ID NO:45, an adenine at a position corresponding to position 690 according to SEQ ID NO:47, an adenine at a position corresponding to position 631 according to SEQ ID NO:49, or an adenine at a position corresponding to position 712 according to SEQ ID NO:51 (cDNA molecule), the biological sample can be subjected to an amplification method using a primer pair that includes a first primer derived from the 5' flanking sequence adjacent to an adenine at a position corresponding to position 42,990 according to SEQ ID NO:3 (genomic nucleic acid molecule), or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27 (mRNA molecule), or an adenine at a position corresponding to position 648 according to SEQ ID NO:37, an adenine at a position corresponding to position 648 according to SEQ ID NO:39, an adenine at a position corresponding to position 648 according to SEQ ID NO:41, an adenine at a position corresponding to position 622 according to SEQ ID NO:43, an adenine at a position corresponding to position 641 according to SEQ ID NO:45, an adenine at a position corresponding to position 690 according to SEQ ID NO:47, an adenine at a position corresponding to position 631 according to SEQ ID NO:49, or an adenine at a position corresponding to position 712 according to SEQ ID NO:51 (cDNA molecule), and a second primer derived from the 3' flanking sequence adjacent to an adenine at a position corresponding to position 42,990 according to SEQ ID NO:3 (genomic nucleic acid molecule), or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27 (mRNA molecule), or an adenine at a position corresponding to position 648 according to SEQ ID NO:37, an adenine at a position corresponding to position 648 according to SEQ ID NO:39, an adenine at a position corresponding to position 648 according to SEQ ID NO:41, an adenine at a position corresponding to position 622 according to SEQ ID NO:43, an adenine at a position corresponding to position 641 according to SEQ ID NO:45, an adenine at a position corresponding to position 690 according to SEQ ID NO:47, an adenine at a position corresponding to position 631 according to SEQ ID NO:49, or an adenine at a position corresponding to position 712 according to SEQ ID NO:51 (cDNA molecule) to produce an amplicon that is indicative of the presence of the SNP at positions encoding an adenine at a position corresponding to position 42,990 according to SEQ ID NO:3 (genomic nucleic acid molecule), or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27 (mRNA molecule), or an adenine at a position corresponding to position 648 according to SEQ ID NO:37, an adenine at a position corresponding to position 648 according to SEQ ID NO:39, an adenine at a position corresponding to position 648 according to SEQ ID NO:41, an adenine at a position corresponding to position 622 according to SEQ ID NO:43, an adenine at a position corresponding to position 641 according to SEQ ID NO:45, an adenine at a position corresponding to position 690 according to SEQ ID NO:47, an adenine at a position corresponding to position 631 according to SEQ ID NO:49, or an adenine at a position corresponding to position 712 according to SEQ ID NO:51

(cDNA molecule). In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions comprising an adenine at a position corresponding to position 42,990 according to SEQ ID NO:3 (genomic nucleic acid molecule), or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27 (mRNA molecule), or an adenine at a position corresponding to position 648 according to SEQ ID NO:37, an adenine at a position corresponding to position 648 according to SEQ ID NO:39, an adenine at a position corresponding to position 648 according to SEQ ID NO:41, an adenine at a position corresponding to position 622 according to SEQ ID NO:43, an adenine at a position corresponding to position 641 according to SEQ ID NO:45, an adenine at a position corresponding to position 690 according to SEQ ID NO:47, an adenine at a position corresponding to position 631 according to SEQ ID NO:49, or an adenine at a position corresponding to position 712 according to SEQ ID NO:51 (cDNA molecule), and at least 1, 2, 3, 4, 5, 6, 7, 8, 9, 10, or more nucleotides on each side of positions comprising an adenine at a position corresponding to position 42,990 according to SEQ ID NO:3 (genomic nucleic acid molecule), or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27 (mRNA molecule), or an adenine at a position corresponding to position 648 according to SEQ ID NO:37, an adenine at a position corresponding to position 648 according to SEQ ID NO:39, an adenine at a position corresponding to position 648 according to SEQ ID NO:41, an adenine at a position corresponding to position 622 according to SEQ ID NO:43, an adenine at a position corresponding to position 641 according to SEQ ID NO:45, an adenine at a position corresponding to position 690 according to SEQ ID NO:47, an adenine at a position corresponding to position 631 according to SEQ ID NO:49, or an adenine at a position corresponding to position 712 according to SEQ ID NO:51 (cDNA molecule).

Similar amplicons can be generated from the mRNA and/or cDNA sequences. PCR primer pairs can be derived from a known sequence, for example, by using computer programs intended for that purpose, such as the PCR primer analysis tool in Vector NTI version 10 (Informax Inc., Bethesda Md.); PrimerSelect (DNASTAR Inc., Madison, Wis.); and Primer3 (Version 0.4.0.©, 1991, Whitehead Institute for Biomedical Research, Cambridge, Mass.). Additionally, the sequence can be visually scanned and primers manually identified using known guidelines.

Illustrative examples of nucleic acid sequencing techniques include, but are not limited to, chain terminator (Sanger) sequencing and dye terminator sequencing. Other methods involve nucleic acid hybridization methods other than sequencing, including using labeled primers or probes directed against purified DNA, amplified DNA, and fixed cell preparations (fluorescence in situ hybridization (FISH)). In some methods, a target nucleic acid molecule may be amplified prior to or simultaneous with detection. Illustrative examples of nucleic acid amplification techniques include, but are not limited to, polymerase chain reaction (PCR), ligase chain reaction (LCR), strand displacement amplification (SDA), and nucleic acid sequence based amplification (NASBA). Other methods include, but are not limited to, ligase chain reaction, strand displacement amplification, and thermophilic SDA (tSDA).

In hybridization techniques, stringent conditions can be employed such that a probe or primer will specifically hybridize to its target. In some embodiments, a polynucleotide primer or probe under stringent conditions will hybridize to its target sequence to a detectably greater degree than to other non-target sequences, such as, at least 2-fold, at least 3-fold, at least 4-fold, or more over background, including over 10-fold over background. In some embodiments, a polynucleotide primer or probe under stringent conditions will hybridize to its target nucleotide sequence to a detectably greater degree than to other nucleotide sequences by at least 2-fold. In some embodiments, a polynucleotide primer or probe under stringent conditions will hybridize to its target nucleotide sequence to a detectably greater degree than to other nucleotide sequences by at least 3-fold. In some embodiments, a polynucleotide primer or probe under stringent conditions will hybridize to its target nucleotide sequence to a detectably greater degree than to other nucleotide sequences by at least 4-fold. In some embodiments, a polynucleotide primer or probe under stringent conditions will hybridize to its target nucleotide sequence to a detectably greater degree than to other nucleotide sequences by over 10-fold over background. Stringent conditions are sequence-dependent and will be different in different circumstances.

Appropriate stringency conditions which promote DNA hybridization, for example, 6× sodium chloride/sodium citrate (SSC) at about 45° C., followed by a wash of 2×SSC at 50° C., are known or can be found in Current Protocols in Molecular Biology, John Wiley & Sons, N.Y. (1989), 6.3.1-6.3.6. Typically, stringent conditions for hybridization and detection will be those in which the salt concentration is less than about 1.5 M $Na^+$ ion, typically about 0.01 to 1.0 M $Na^+$ ion concentration (or other salts) at pH 7.0 to 8.3 and the temperature is at least about 30° C. for short probes (such as, for example, 10 to 50 nucleotides) and at least about 60° C. for longer probes (such as, for example, greater than 50 nucleotides). Stringent conditions may also be achieved with the addition of destabilizing agents such as formamide.

Optionally, wash buffers may comprise about 0.1% to about 1% SDS. Duration of hybridization is generally less than about 24 hours, usually about 4 to about 12 hours. The duration of the wash time will be at least a length of time sufficient to reach equilibrium.

The present disclosure also provides methods of detecting the presence of a human SOS2 predicted loss-of-function polypeptide comprising performing an assay on a sample obtained from a human subject to determine whether an SOS2 polypeptide in the subject contains one or more variations that causes the polypeptide to have a loss-of-function (partial or complete) or predicted loss-of-function (partial or complete). The SOS2 predicted loss-of-function polypeptide can be any of the SOS2 variant polypeptides described herein. In some embodiments, the methods detect the presence of SOS2 Pro191Arg (Isoform 1), Ala208Thr (Isoform 1), Pro191Arg (Isoform 2), Ala208Thr (Isoform 2), Pro221Arg, or Ala238Thr. In some embodiments, the methods detect the presence of SOS2 Pro191Arg (Isoform 1) or Ala208Thr (Isoform 1).

In some embodiments, the methods comprise performing an assay on a sample obtained from a human subject to determine whether an SOS2 polypeptide in the sample comprises an arginine at a position corresponding to position 191 according to SEQ ID NO:55. In some embodiments, the methods comprise performing an assay on a sample obtained from a human subject to determine whether an SOS2 polypeptide in the sample comprises a threonine at a position corresponding to position 208 according to SEQ ID NO:56. In some embodiments, the methods comprise performing an assay on a sample obtained from a human subject to determine whether an SOS2 polypeptide in the sample comprises an arginine at a position corresponding to position 191 according to SEQ ID NO:57. In some embodiments, the methods comprise performing an assay on a sample obtained from a human subject to determine whether an SOS2 polypeptide in the sample comprises a threonine at a position corresponding to position 208 according to SEQ ID NO:58. In some embodiments, the methods comprise performing an assay on a sample obtained from a human subject to determine whether an SOS2 polypeptide in the sample comprises an arginine at a position corresponding to position 221 according to SEQ ID NO:59. In some embodiments, the methods comprise performing an assay on a sample obtained from a human subject to determine whether an SOS2 polypeptide in the sample comprises threonine at a position corresponding to position 238 according to SEQ ID NO:60.

In some embodiments, the detecting step comprises sequencing at least a portion of the polypeptide that comprises a position corresponding to position 191 according to SEQ ID NO:55, SEQ ID NO:52, or SEQ ID NO:53. In some embodiments, the detecting step comprises sequencing at least a portion of the polypeptide that comprises a position corresponding to position 208 according to SEQ ID NO:56, SEQ ID NO:52, or SEQ ID NO:53. In some embodiments, the detecting step comprises sequencing at least a portion of the polypeptide that comprises a position corresponding to position 191 according to SEQ ID NO:57, SEQ ID NO:52, or SEQ ID NO:53. In some embodiments, the detecting step comprises sequencing at least a portion of the polypeptide that comprises a position corresponding to position 208 according to SEQ ID NO:58, SEQ ID NO:52, or SEQ ID NO:53. In some embodiments, the detecting step comprises sequencing at least a portion of the polypeptide that comprises a position corresponding to position 221 according to SEQ ID NO:59 or SEQ ID NO:54. In some embodiments, the detecting step comprises sequencing at least a portion of the polypeptide that comprises a position corresponding to position 238 according to SEQ ID NO:60 or SEQ ID NO:54.

In some embodiments, the detecting step comprises an immunoassay for detecting the presence of a polypeptide that comprises a position corresponding to position 191 according to SEQ ID NO:55, SEQ ID NO:52, or SEQ ID NO:53. In some embodiments, the detecting step comprises an immunoassay for detecting the presence of a polypeptide that comprises a position corresponding to position 208 according to SEQ ID NO:56, SEQ ID NO:52, or SEQ ID NO:53. In some embodiments, the detecting step comprises an immunoassay for detecting the presence of a polypeptide that comprises a position 191 according to SEQ ID NO:57, SEQ ID NO:52, or SEQ ID NO:53. In some embodiments, the detecting step comprises an immunoassay for detecting the presence of a polypeptide that comprises a position corresponding to position 208 according to SEQ ID NO:58, SEQ ID NO:52, or SEQ ID NO:53. In some embodiments, the detecting step comprises an immunoassay for detecting the presence of a polypeptide that comprises a position corresponding to position 221 according to SEQ ID NO:59 or SEQ ID NO:54. In some embodiments, the detecting step comprises an immunoassay for detecting the presence of a polypeptide that comprises a position corresponding to position 238 according to SEQ ID NO:60 or SEQ ID NO:54.

In some embodiments, when the human subject does not have an SOS2 predicted loss-of-function polypeptide, then the human subject has an increased risk for developing an ophthalmic condition or any of increased IOP, glaucoma, pre-glaucoma, and/or decreased corneal hysteresis. In some embodiments, when the human subject has an SOS2 predicted loss-of-function polypeptide, then the human subject has a decreased risk for developing an ophthalmic condition or any of increased IOP, glaucoma, pre-glaucoma, and/or decreased corneal hysteresis.

The present disclosure also provides isolated nucleic acid molecules that hybridize to SOS2 variant genomic nucleic acid molecules, SOS2 variant mRNA molecules, and/or SOS2 variant cDNA molecules (such as any of the genomic variant nucleic acid molecules, mRNA variant molecules, and cDNA variant molecules disclosed herein). In some embodiments, the isolated nucleic acid molecules hybridize to a portion of the SOS2 nucleic acid molecule that includes a position corresponding to: position 42,940 according to SEQ ID NO:2; position 598 according to SEQ ID NO:12, position 598 according to SEQ ID NO:14, position 598 according to SEQ ID NO:16, position 572 according to SEQ ID NO:18, position 591 according to SEQ ID NO:20, position 640 according to SEQ ID NO:22, position 581 according to SEQ ID NO:24, or position 662 according to SEQ ID NO:26; or position 598 according to SEQ ID NO:36, position 598 according to SEQ ID NO:38, position 598 according to SEQ ID NO:40, position 572 according to SEQ ID NO:42, position 591 according to SEQ ID NO:44, position 640 according to SEQ ID NO:46, position 581 according to SEQ ID NO:48, or position 662 according to SEQ ID NO:50. In some embodiments, the isolated nucleic acid molecules hybridize to a portion of the SOS2 nucleic acid molecule that includes a position corresponding to: position 42,990 according to SEQ ID NO:3; position 648 according to SEQ ID NO:13, position 648 according to SEQ ID NO:15, position 648 according to SEQ ID NO:17, position 622 according to SEQ ID NO:19, position 641 according to SEQ ID NO:21, position 690 according to SEQ ID NO:23, position 631 according to SEQ ID NO:25, or position 712 according to SEQ ID NO:27; or position 648 according to SEQ ID NO:37, position 648 according to SEQ ID NO:39, position 648 according to SEQ ID NO:41, position 622 according to SEQ ID NO:43, position 641 according to SEQ ID NO:45, position 690 according to SEQ ID NO:47, position 631 according to SEQ ID NO:49, or position 712 according to SEQ ID NO:51.

In some embodiments, such isolated nucleic acid molecules comprise or consist of at least about 5, at least about 8, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, at least about 25, at least about 30, at least about 35, at least about 40, at least about 45, at least about 50, at least about 55, at least about 60, at least about 65, at least about 70, at least about 75, at least about 80, at least about 85, at least about 90, at least about 95, at least about 100, at least about 200, at least about 300, at least about 400, at least about 500, at least about 600, at least about 700, at least about 800, at least about 900, at least about 1000, at least about 2000, at least about 3000, at least about 4000, or at least about 5000 nucleotides. In some embodiments, such isolated nucleic acid molecules comprise or consist of at least about 5, at least about 8, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, or at least about 25 nucleotides. In some embodiments, the isolated nucleic acid molecules comprise or consist of at least about 18 nucleotides. In some embodiments, the isolated nucleic acid molecules comprise or consists of at least about 15 nucleotides. In some embodiments, the isolated nucleic acid molecules consist of or comprise from about 10 to about 35, from about 10 to about 30, from about 10 to about 25, from about 12 to about 30, from about 12 to about 28, from about 12 to about 24, from about 15 to about 30, from about 15 to about 25, from about 18 to about 30, from about 18 to about 25, from about 18 to about 24, or from about 18 to about 22 nucleotides. In some embodiments, the isolated nucleic acid molecules consist of or comprise from about 18 to about 30 nucleotides. In some embodiments, the isolated nucleic acid molecules comprise or consist of at least about 15 nucleotides to at least about 35 nucleotides.

In some embodiments, such isolated nucleic acid molecules hybridize to SOS2 variant nucleic acid molecules (such as genomic nucleic acid molecules, mRNA molecules, and/or cDNA molecules) under stringent conditions. Such nucleic acid molecules can be used, for example, as probes, primers, alteration-specific probes, or alteration-specific primers as described or exemplified herein, and include, without limitation primers, probes, antisense RNAs, shRNAs, and siRNAs, each of which is described in more detail elsewhere herein, and can be used in any of the methods described herein.

In some embodiments, the isolated nucleic acid molecules hybridize to at least about 15 contiguous nucleotides of a nucleic acid molecule that is at least about 70%, at least about 75%, at least about 80%, at least about 85%, at least about 90%, at least about 95%, at least about 96%, at least about 97%, at least about 98%, at least about 99%, or 100% identical to SOS2 variant genomic nucleic acid molecules, SOS2 variant mRNA molecules, and/or SOS2 variant cDNA molecules. In some embodiments, the isolated nucleic acid molecules consist of or comprise from about 15 to about 100 nucleotides, or from about 15 to about 35 nucleotides. In some embodiments, the isolated nucleic acid molecules consist of or comprise from about 15 to about 100 nucleotides. In some embodiments, the isolated nucleic acid molecules consist of or comprise from about 15 to about 35 nucleotides.

In some embodiments, the isolated alteration-specific probes or alteration-specific primers comprise at least about 15 nucleotides, wherein the alteration-specific probe or alteration-specific primer comprises a nucleotide sequence which is complementary to a portion of a nucleotide sequence encoding a human SOS2 polypeptide, wherein the portion comprises a position corresponding to: position 42,940 according to SEQ ID NO:2, or the complement thereof; position 598 according to SEQ ID NO:12, or the complement thereof; position 598 according to SEQ ID NO:14, or the complement thereof; position 598 according to SEQ ID NO:16, or the complement thereof; position 572 according to SEQ ID NO:18, or the complement thereof; position 591 according to SEQ ID NO:20, or the complement thereof;

position 640 according to SEQ ID NO:22, or the complement thereof; position 581 according to SEQ ID NO:24, or the complement thereof; or position 662 according to SEQ ID NO:26, or the complement thereof; or position 598 according to SEQ ID NO:36, or the complement thereof; position 598 according to SEQ ID NO:38, or the complement thereof; position 598 according to SEQ ID NO:40, or the complement thereof; position 572 according to SEQ ID NO:42, or the complement thereof; position 591 according to SEQ ID NO:44, or the complement thereof; position 640 according to SEQ ID NO:46, or the complement thereof; position 581 according to SEQ ID NO:48, or the complement thereof; or position 662 according to SEQ ID NO:50, or the complement thereof. In some embodiments, the alteration-specific probe or alteration-specific primer comprises a nucleotide sequence which is complementary to a portion of a nucleotide sequence comprising positions corresponding to: i) positions 42,939 to 42,941 according to SEQ ID NO:2, or the complement thereof; ii) positions 597 to 599 according to SEQ ID NO:12, or the complement thereof; positions 597 to 599 according to SEQ ID NO:14, or the complement thereof; positions 597 to 599 according to SEQ ID NO:16, or the complement thereof; positions 571 to 573 according to SEQ ID NO:18, or the complement thereof; positions 590 to 592 according to SEQ ID NO:20, or the complement thereof; positions 639 to 641 according to SEQ ID NO:22, or the complement thereof; positions 580 to 582 according to SEQ ID NO:24, or the complement thereof; or positions 661 to 663 according to SEQ ID NO:26, or the complement thereof; and/or iii) positions 597 to 599 according to SEQ ID NO:36, or the complement thereof; positions 597 to 599 according to SEQ ID NO:38, or the complement thereof; positions 597 to 599 according to SEQ ID NO:40, or the complement thereof; positions 571 to 573 according to SEQ ID NO:42, or the complement thereof; positions 590 to 592 according to SEQ ID NO:44, or the complement thereof; positions 639 to 641 according to SEQ ID NO:46, or the complement thereof; positions 580 to 582 according to SEQ ID NO:48, or the complement thereof; or positions 661 to 663 according to SEQ ID NO:50, or the complement thereof.

In some embodiments, the isolated alteration-specific probes or alteration-specific primers comprise at least about 15 nucleotides, wherein the alteration-specific probe or alteration-specific primer comprises a nucleotide sequence which is complementary to a portion of a nucleotide sequence encoding a human SOS2 polypeptide, wherein the portion comprises a position corresponding to: position 42,990 according to SEQ ID NO:3, or the complement thereof; position 648 according to SEQ ID NO:13, or the complement thereof; position 648 according to SEQ ID NO:15, or the complement thereof; position 648 according to SEQ ID NO:17, or the complement thereof; position 622 according to SEQ ID NO:19, or the complement thereof; position 641 according to SEQ ID NO:21, or the complement thereof; position 690 according to SEQ ID NO:23, or the complement thereof; position 631 according to SEQ ID NO:25, or the complement thereof; or position 712 according to SEQ ID NO:27, or the complement thereof; or position 648 according to SEQ ID NO:37, or the complement thereof; position 648 according to SEQ ID NO:39, or the complement thereof; position 648 according to SEQ ID NO:41, or the complement thereof; position 622 according to SEQ ID NO:43, or the complement thereof; position 641 according to SEQ ID NO:45, or the complement thereof; position 690 according to SEQ ID NO:47, or the complement thereof; position 631 according to SEQ ID NO:49, or the complement thereof; or position 712 according to SEQ ID NO:51, or the complement thereof. In some embodiments, the alteration-specific probe or alteration-specific primer comprises a nucleotide sequence which is complementary to a portion of a nucleotide sequence comprising positions corresponding to: i) positions 42,990 to 42,992 according to SEQ ID NO:3, or the complement thereof; ii) positions 648 to 650 according to SEQ ID NO:13, or the complement thereof; positions 648 to 650 according to SEQ ID NO:15, or the complement thereof; positions 648 to 650 according to SEQ ID NO:17, or the complement thereof; positions 622 to 624 according to SEQ ID NO:19, or the complement thereof; positions 641 to 643 according to SEQ ID NO:21, or the complement thereof; positions 690 to 692 according to SEQ ID NO:23, or the complement thereof; positions 631 to 633 according to SEQ ID NO:25, or the complement thereof; or positions 712 to 714 according to SEQ ID NO:27, or the complement thereof; and/or positions 648 to 650 according to SEQ ID NO:37, or the complement thereof; positions 648 to 650 according to SEQ ID NO:39, or the complement thereof; positions 648 to 650 according to SEQ ID NO:41, or the complement thereof; positions 622 to 624 according to SEQ ID NO:43, or the complement thereof; positions 641 to 643 according to SEQ ID NO:45, or the complement thereof; positions 690 to 692 according to SEQ ID NO:47, or the complement thereof; positions 631 to 633 according to SEQ ID NO:49, or the complement thereof; or positions 712 to 714 according to SEQ ID NO:51, or the complement thereof.

In some embodiments, the alteration-specific probes and alteration-specific primers comprise DNA. In some embodiments, the alteration-specific probes and alteration-specific primers comprise RNA.

In some embodiments, the probes and primers described herein (including alteration-specific probes and alteration-specific primers) have a nucleotide sequence that specifically hybridizes to any of the nucleic acid molecules disclosed herein, or the complement thereof. In some embodiments, the probes and primers specifically hybridize to any of the nucleic acid molecules disclosed herein under stringent conditions.

In some embodiments, the primers, including alteration-specific primers, can be used in second generation sequencing or high throughput sequencing. In some instances, the primers, including alteration-specific primers, can be modified. In particular, the primers can comprise various modifications that are used at different steps of, for example, Massive Parallel Signature Sequencing (MPSS), Polony sequencing, and 454 Pyrosequencing. Modified primers can be used at several steps of the process, including biotinylated primers in the cloning step and fluorescently labeled primers used at the bead loading step and detection step. Polony sequencing is generally performed using a paired-end tags library wherein each molecule of DNA template is about 135 bp in length. Biotinylated primers are used at the bead loading step and emulsion PCR. Fluorescently labeled degenerate nonamer oligonucleotides are used at the detection step. An adaptor can contain a 5'-biotin tag for immobilization of the DNA library onto streptavidin-coated beads.

The probes and primers described herein can be used to detect a nucleotide variation within any of the SOS2 variant genomic nucleic acid molecules, SOS2 variant mRNA molecules, and/or SOS2 variant cDNA molecules disclosed herein. The primers described herein can be used to amplify SOS2 variant genomic nucleic acid molecules, SOS2 variant mRNA molecules, or SOS2 variant cDNA molecules, or a fragment thereof.

The present disclosure also provides pairs of primers comprising any of the primers described above. For example, if one of the primers' 3'-ends hybridizes to a cytosine at a position coresponding to position 42,940 according to SEQ ID NO:1 (rather than guanine) in a particular SOS2 nucleic acid molecule, then the presence of the amplified fragment would indicate the presence of an SOS2 reference genomic nucleic acid molecule. Conversely, if one of the primers' 3'-ends hybridizes to a guanine at a position corresponding to position 42,940 according to SEQ ID NO:2 (rather than cytosine) in a particular SOS2 nucleic acid molecule, then the presence of the amplified fragment would indicate the presence of the SOS2 variant genomic nucleic acid molecule. In some embodiments, the nucleotide of the primer complementary to the guanine at a position corresponding to position 42,940 according to SEQ ID NO:2 can be at the 3' end of the primer. In addition, if one of the primers' 3'-ends hybridizes to a cytosine at a position corresponding to position 598 according to SEQ ID NO:4 (rather than guanine) in a particular SOS2 nucleic acid molecule, then the presence of the amplified fragment would indicate the presence of an SOS2 reference mRNA molecule. Conversely, if one of the primers' 3'-ends hybridizes to a guanine at a position corresponding to position 598 according to SEQ ID NO:12 (rather than cytosine) in a particular SOS2 mRNA molecule, then the presence of the amplified fragment would indicate the presence of the SOS2 variant mRNA molecule. The same can be carried out for the other mRNA isoforms. In some embodiments, the nucleotide of the primer complementary to the guanine at a position corresponding to position 598 according to SEQ ID NO:12 can be at the 3' end of the primer. The same can be carried out for the other mRNA isoforms. In addition, if one of the primers' 3'-ends hybridizes to a cytosine at a position corresponding to position 598 according to SEQ ID NO:28 (rather than guanine) in a particular SOS2 nucleic acid molecule, then the presence of the amplified fragment would indicate the presence of an SOS2 reference cDNA molecule. Conversely, if one of the primers' 3'-ends hybridizes to a guanine at a position corresponding to position 598 according to SEQ ID NO:36 (rather than cytosine) in a particular SOS2 cDNA molecule, then the presence of the amplified fragment would indicate the presence of the SOS2 variant cDNA molecule. In some embodiments, the nucleotide of the primer complementary to the guanine at a position corresponding to position 598 according to SEQ ID NO:36 can be at the 3' end of the primer. The same can be carried out for the other cDNA isoforms.

If, for example, one of the primers' 3'-ends hybridizes to a guanine at a position corresponding to position 42,990 according to SEQ ID NO:1 (rather than adenine) in a particular SOS2 nucleic acid molecule, then the presence of the amplified fragment would indicate the presence of an SOS2 reference genomic nucleic acid molecule. Conversely, if one of the primers' 3'-ends hybridizes to an adenine at a position corresponding to position 42,990 according to SEQ ID NO:3 (rather than guanine) in a particular SOS2 nucleic acid molecule, then the presence of the amplified fragment would indicate the presence of the SOS2 variant genomic nucleic acid molecule. In some embodiments, the nucleotide of the primer complementary to the adenine at a position corresponding to position 42,990 according to SEQ ID NO:3 can be at the 3' end of the primer. In addition, if one of the primers' 3'-ends hybridizes to a guanine at a position corresponding to position 648 according to SEQ ID NO:4 (rather than adenine) in a particular SOS2 nucleic acid molecule, then the presence of the amplified fragment would indicate the presence of an SOS2 reference mRNA molecule. Conversely, if one of the primers' 3'-ends hybridizes to an adenine at a position corresponding to position 648 according to SEQ ID NO:13 (rather than guanine) in a particular SOS2 mRNA molecule, then the presence of the amplified fragment would indicate the presence of the SOS2 variant mRNA molecule. In some embodiments, the nucleotide of the primer complementary to the adenine at a position corresponding to position 648 according to SEQ ID NO:13 can be at the 3' end of the primer. The same can be carried out for the other mRNA isoforms. In addition, if one of the primers' 3'-ends hybridizes to a guanine at a position corresponding to position 648 according to SEQ ID NO:28 (rather than adenine) in a particular SOS2 nucleic acid molecule, then the presence of the amplified fragment would indicate the presence of an SOS2 reference cDNA molecule. Conversely, if one of the primers' 3'-ends hybridizes to an adenine at a position corresponding to position 648 according to SEQ ID NO:37 (rather than guanine) in a particular SOS2 cDNA molecule, then the presence of the amplified fragment would indicate the presence of the SOS2 variant cDNA molecule. In some embodiments, the nucleotide of the primer complementary to the adenine at a position corresponding to position 648 according to SEQ ID NO:37 can be at the 3' end of the primer. The same can be carried out for the other cDNA isoforms.

In the context of the disclosure "specifically hybridizes" means that the probe or primer (such as, for example, the alteration-specific probe or alteration-specific primer) does not hybridize to a nucleic acid sequence encoding an SOS2 reference genomic nucleic acid molecule, an SOS2 reference mRNA molecule, and/or an SOS2 reference cDNA molecule.

In some embodiments, the probes (such as, for example, an alteration-specific probe) comprise a label. In some embodiments, the label is a fluorescent label, a radiolabel, or biotin.

The present disclosure also provides supports comprising a substrate to which any one or more of the probes disclosed herein is attached. Solid supports are solid-state substrates or supports with which molecules, such as any of the probes disclosed herein, can be associated. A form of solid support is an array. Another form of solid support is an array detector. An array detector is a solid support to which multiple different probes have been coupled in an array, grid, or other organized pattern. A form for a solid-state substrate is a microtiter dish, such as a standard 96-well type. In some embodiments, a multiwell glass slide can be employed that normally contains one array per well.

The present disclosure also provides molecular complexes comprising or consisting of any of theSon of Sevenless 2 (SOS2) nucleic acid molecules (genomic nucleic acid molecules, mRNA molecules, or cDNA molecules), or complement thereof, described herein and any of the alteration-specific primers or alteration-specific probes described herein. In some embodiments, the SOS2 nucleic acid molecules (genomic nucleic acid molecules, mRNA molecules, or cDNA molecules), or complement thereof, in the molecular complexes are single-stranded. In some embodiments, the SOS2 nucleic acid molecule is any of the genomic nucleic acid molecules described herein. In some embodiments, the SOS2 nucleic acid molecule is any of the mRNA molecules described herein. In some embodiments, the SOS2 nucleic acid molecule is any of the cDNA molecules described herein. In some embodiments, the molecular complex comprises or consists of any of the SOS2 nucleic acid molecules (genomic nucleic acid molecules, mRNA molecules, or cDNA molecules), or complement thereof, described herein and any of the alteration-specific primers described herein. In some embodiments, the molecular complex comprises or consists of any of the SOS2 nucleic acid molecules (genomic nucleic acid molecules, mRNA molecules, or cDNA molecules), or complement thereof, described herein and any of the alteration-specific probes described herein.

In some embodiments, the molecular complex comprises or consists of an alteration-specific primer or an alteration-specific probe hybridized to a genomic nucleic acid molecule comprising a nucleotide sequence encoding a human SOS2 polypeptide, wherein the alteration-specific primer or the alteration-specific probe is hybridized to: a guanine at a position corresponding to position 42,940 according to SEQ ID NO:2, or the complement thereof; or an adenine at a position corresponding to position 42,990 according to SEQ ID NO:3, or the complement thereof.

In some embodiments, the molecular complex comprises or consists of an alteration-specific primer or an alteration-specific probe that is hybridized to: a CGT codon at positions corresponding to positions 42,939 to 42,941 according to SEQ ID NO:2; or a ACA codon at positions corresponding to positions 42,990 to 42,992 according to SEQ ID NO:3.

In some embodiments, the molecular complex comprises or consists of a genomic nucleic acid molecule that comprises SEQ ID NO:2 or SEQ ID NO:3. In some embodiments, the molecular complex comprises or consists of a genomic nucleic acid molecule that comprises SEQ ID NO:2. In some embodiments, the molecular complex comprises or consists of a genomic nucleic acid molecule that comprises SEQ ID NO:3.

In some embodiments, the molecular complex comprises or consists of an alteration-specific primer or an alteration-specific probe hybridized to an mRNA molecule comprising a nucleotide sequence encoding a human SOS2 polypeptide, wherein the alteration-specific primer or the alteration-specific probe is hybridized to: i) a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; or ii) an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof.

In some embodiments, the molecular complex comprises or consists of an alteration-specific primer or an alteration-specific probe that is hybridized to: i) a CGU codon at positions corresponding to positions 597 to 599 according to SEQ ID NO:12, a CGU codon at positions corresponding to positions 597 to 599 according to SEQ ID NO:14, a CGU codon at positions corresponding to positions 597 to 599 according to SEQ ID NO:16, a CGU codon at positions corresponding to positions 571 to 573 according to SEQ ID NO:18, a CGU codon at positions corresponding to positions 590 to 592 according to SEQ ID NO:20, a CGU codon at positions corresponding to positions 639 to 641 according to SEQ ID NO:22, a CGU codon at positions corresponding to positions 580 to 582 according to SEQ ID NO:24, or a CGU codon at positions corresponding to positions 661 to 663 according to SEQ ID NO:26; or ii) an ACA codon at positions corresponding to positions 648 to 650 according to SEQ ID NO:13, an ACA codon at positions corresponding to positions 648 to 650 according to SEQ ID NO:15, an ACA codon at positions corresponding to positions 648 to 650 according to SEQ ID NO:17, an ACA codon at positions corresponding to positions 622 to 624 according to SEQ ID NO:19, an ACA codon at positions corresponding to positions 641 to 643 according to SEQ ID NO:21, an ACA codon at positions corresponding to positions 690 to 692 according to SEQ ID NO:23, an ACA codon at positions corresponding to positions 631 to 633 according to SEQ ID NO:25, or an ACA codon at positions corresponding to positions 712 to 714 according to SEQ ID NO:27.

In some embodiments, the molecular complex comprises or consists of an mRNA molecule that comprises SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:13, SEQ ID NO:15, SEQ ID NO:17, SEQ ID NO:19, SEQ ID NO:21, SEQ ID NO:23, SEQ ID NO:25, or SEQ ID NO:27. In some embodiments, the molecular complex comprises or consists of an mRNA molecule that comprises SEQ ID NO:12 or SEQ ID NO:13. In some embodiments, the molecular complex comprises or consists of an mRNA molecule that comprises SEQ ID NO:12. In some embodiments, the molecular complex comprises or consists of an mRNA molecule that comprises SEQ ID NO:13.

In some embodiments, the molecular complex comprises or consists of an alteration-specific primer or an alteration-specific probe hybridized to a cDNA molecule comprising a nucleotide sequence encoding a human SOS2 polypeptide, wherein the alteration-specific primer or the alteration-specific probe is hybridized to: i) a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50, or the complement thereof; or ii) an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof.

In some embodiments, the molecular complex comprises or consists of an alteration-specific primer or an alteration-specific probe that is hybridized to: i) a CGT codon at positions corresponding to positions 597 to 599 according to SEQ ID NO:36, a CGT codon at positions corresponding to positions 597 to 599 according to SEQ ID NO:38, a CGT codon at positions corresponding to positions 597 to 599 according to SEQ ID NO:40, a CGT codon at positions corresponding to positions 571 to 573 according to SEQ ID NO:42, a CGT codon at positions corresponding to positions 590 to 592 according to SEQ ID NO:44, a CGT codon at positions corresponding to positions 639 to 641 according to SEQ ID NO:46, a CGT codon at positions corresponding to positions 580 to 582 according to SEQ ID NO:48, or a CGT codon at positions corresponding to positions 661 to 663 according to SEQ ID NO:50; or ii) an ACA codon at positions corresponding to positions 648 to 650 according to SEQ ID NO:37, an ACA codon at positions corresponding to positions 648 to 650 according to SEQ ID NO:39, an ACA codon at positions corresponding to positions 648 to 650 according to SEQ ID NO:41, an ACA codon at positions corresponding to positions 622 to 624 according to SEQ ID NO:43, an ACA codon at positions corresponding to positions 641 to 643 according to SEQ ID NO:45, an ACA codon at positions corresponding to positions 690 to 692 according to SEQ ID NO:47, an ACA codon at positions corresponding to positions 631 to 633 according to SEQ ID NO:49, or an ACA codon at positions corresponding to positions 712 to 714 according to SEQ ID NO:51.

In some embodiments, the molecular complex comprises or consists of a cDNA molecule that comprises SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:37, SEQ ID NO:39, SEQ ID NO:41, SEQ ID NO:43, SEQ ID NO:45, SEQ ID NO:47, SEQ ID NO:49, or SEQ ID NO:51. In some embodiments, the molecular complex comprises or consists of an mRNA molecule that comprises SEQ ID NO:36 or SEQ ID NO:37. In some embodiments, the molecular complex comprises or consists of an mRNA molecule that comprises SEQ ID NO:36. In some embodiments, the molecular complex comprises or consists of an mRNA molecule that comprises SEQ ID NO:37.

In some embodiments, the molecular complex comprises an alteration-specific probe or an alteration-specific primer comprising a label. In some embodiments, the label is a fluorescent label, a radiolabel, or biotin. In some embodiments, the molecular complex further comprises a non-human polymerase.

The nucleotide sequence of an SOS2 reference genomic nucleic acid molecule is set forth in SEQ ID NO:1. Referring to SEQ ID NO:1, position 42,940 is a cytosine. Referring to SEQ ID NO:1, position 42,990 is a guanine.

A variant genomic nucleic acid molecule of SOS2 exists, wherein the cytosine at position 42,940 is replaced with guanine. The nucleotide sequence of this SOS2 variant genomic nucleic acid molecule is set forth in SEQ ID NO:2.

Another variant genomic nucleic acid molecule of SOS2 exists, wherein the guanine at position 42,990 is replaced with adenine. The nucleotide sequence of this SOS2 variant genomic nucleic acid molecule is set forth in SEQ ID NO:3.

The nucleotide sequences of SOS2 reference mRNA molecules are set forth in SEQ ID NO:4 (Isoform 1), SEQ ID NO:5 (Isoform 2), SEQ ID NO:6 (Isoform 3), SEQ ID NO:7 (Isoform 4), SEQ ID NO:8 (Isoform 5), SEQ ID NO:9 (Isoform 6), SEQ ID NO:10 (Isoform 7), and SEQ ID NO:11 (Isoform 8). Referring to SEQ ID NO:4 (Isoform 1), position 598 is a cytosine, and position 648 is a guanine. Referring to SEQ ID NO:5 (Isoform 2), position 598 is a cytosine, and position 648 is a guanine. Referring to SEQ ID NO:6 (Isoform 3), position 598 is a cytosine, and position 648 is a guanine. Referring to SEQ ID NO:7 (Isoform 4), position 572 is a cytosine, and position 622 is a guanine. Referring to SEQ ID NO:8 (Isoform 5), position 591 is a cytosine, and position 641 is a guanine. Referring to SEQ ID NO:9 (Isoform 6), position 640 is a cytosine, and position 690 is a guanine. Referring to SEQ ID NO:10 (Isoform 7), position 581 is a cytosine, and position 631 is a guanine. Referring to SEQ ID NO:11 (Isoform 8), position 662 is a cytosine, and position 712 is a guanine.

A first set of variant mRNA molecules of SOS2 exists, wherein the cytosine at the positions referred to above for the reference mRNA molecules is replaced by a guanine. Referring to SEQ ID NO:12 (Isoform 1), position 598 is a guanine. Referring to SEQ ID NO:14 (Isoform 2), position 598 is a guanine. Referring to SEQ ID NO:16 (Isoform 3), position 598 is a guanine. Referring to SEQ ID NO:18 (Isoform 4), position 572 is a guanine. Referring to SEQ ID NO:20 (Isoform 5), position 591 is a guanine. Referring to SEQ ID NO:22 (Isoform 6), position 640 is a guanine. Referring to SEQ ID NO:24 (Isoform 7), position 581 is a guanine. Referring to SEQ ID NO:26 (Isoform 8), position 662 is a guanine.

A second set of variant mRNA molecules of SOS2 exists, wherein the guanine at the positions referred to above for the reference mRNA molecules is replaced by an adenine. Referring to SEQ ID NO:13 (Isoform 1), position 648 is an adenine. Referring to SEQ ID NO:15 (Isoform 2), position 648 is an adenine. Referring to SEQ ID NO:17 (Isoform 3), position 648 is an adenine. Referring to SEQ ID NO:19 (Isoform 4), position 622 is an adenine. Referring to SEQ ID NO:21 (Isoform 5), position 641 is an adenine. Referring to SEQ ID NO:23 (Isoform 6), position 690 is an adenine. Referring to SEQ ID NO:25 (Isoform 7), position 631 is an adenine. Referring to SEQ ID NO:27 (Isoform 8), position 712 is an adenine.

The nucleotide sequences of SOS2 reference cDNA molecules are set forth in SEQ ID NO:28 (Isoform 1), SEQ ID NO:29 (Isoform 2), SEQ ID NO:30 (Isoform 3), SEQ ID NO:31 (Isoform 4), SEQ ID NO:32 (Isoform 5), SEQ ID NO:33 (Isoform 6), SEQ ID NO:34 (Isoform 7), and SEQ ID NO:35 (Isoform 8). Referring to SEQ ID NO:28 (Isoform 1), position 598 is a cytosine, and position 648 is a guanine. Referring to SEQ ID NO:29 (Isoform 2), position 598 is a cytosine, and position 648 is a guanine. Referring to SEQ ID NO:30 (Isoform 3), position 598 is a cytosine, and position 648 is a guanine. Referring to SEQ ID NO:31 (Isoform 4), position 572 is a cytosine, and position 622 is a guanine. Referring to SEQ ID NO:32 (Isoform 5), position 591 is a cytosine, and position 641 is a guanine. Referring to SEQ ID NO:33 (Isoform 6), position 640 is a cytosine, and position 690 is a guanine. Referring to SEQ ID NO:34 (Isoform 7), position 581 is a cytosine, and position 631 is a guanine. Referring to SEQ ID NO:35 (Isoform 8), position 662 is a cytosine, and position 712 is a guanine.

A first set of variant cDNA molecules of SOS2 exists, wherein the cytosine at the positions referred to above for the reference cDNA molecules is replaced by a guanine. Referring to SEQ ID NO:36 (Isoform 1), position 598 is a guanine. Referring to SEQ ID NO:38 (Isoform 2), position 598 is a guanine. Referring to SEQ ID NO:40 (Isoform 3), position 598 is a guanine. Referring to SEQ ID NO:42 (Isoform 4), position 572 is a guanine. Referring to SEQ ID NO:44 (Isoform 5), position 591 is a guanine. Referring to SEQ ID NO:46 (Isoform 6), position 640 is a guanine. Referring to SEQ ID NO:48 (Isoform 7), position 581 is a guanine. Referring to SEQ ID NO:50 (Isoform 8), position 662 is a guanine.

A second set of variant cDNA molecules of SOS2 exists, wherein the guanine at the positions referred to above for the reference cDNA molecules is replaced by an adenine. Referring to SEQ ID NO:37 (Isoform 1), position 648 is an adenine. Referring to SEQ ID NO:39 (Isoform 2), position 648 is an adenine. Referring to SEQ ID NO:41 (Isoform 3), position 648 is an adenine. Referring to SEQ ID NO:43 (Isoform 4), position 622 is an adenine. Referring to SEQ ID NO:45 (Isoform 5), position 641 is an adenine. Referring to SEQ ID NO:47 (Isoform 6), position 690 is an adenine. Referring to SEQ ID NO:49 (Isoform 7), position 631 is an adenine. Referring to SEQ ID NO:51 (Isoform 8), position 712 is an adenine.

The genomic nucleic acid molecules, mRNA molecules, and cDNA molecules can be from any organism. For example, the genomic nucleic acid molecules, mRNA molecules, and cDNA molecules can be human or an ortholog from another organism, such as a non-human mammal, a rodent, a mouse, or a rat. It is understood that gene sequences within a population can vary due to polymorphisms such as single-nucleotide polymorphisms. The examples provided herein are only exemplary sequences. Other sequences are also possible.

Also provided herein are functional polynucleotides that can interact with the disclosed nucleic acid molecules.

Examples of functional polynucleotides include, but are not limited to, antisense molecules, aptamers, ribozymes, triplex forming molecules, and external guide sequences. The functional polynucleotides can act as effectors, inhibitors, modulators, and stimulators of a specific activity possessed by a target molecule, or the functional polynucleotides can possess a de novo activity independent of any other molecules.

The isolated nucleic acid molecules disclosed herein can comprise RNA, DNA, or both RNA and DNA. The isolated nucleic acid molecules can also be linked or fused to a heterologous nucleic acid sequence, such as in a vector, or a heterologous label. For example, the isolated nucleic acid molecules disclosed herein can be within a vector or as an exogenous donor sequence comprising the isolated nucleic acid molecule and a heterologous nucleic acid sequence. The isolated nucleic acid molecules can also be linked or fused to a heterologous label. The label can be directly detectable (such as, for example, fluorophore) or indirectly detectable (such as, for example, hapten, enzyme, or fluorophore quencher). Such labels can be detectable by spectroscopic, photochemical, biochemical, immunochemical, or chemical means. Such labels include, for example, radiolabels, pigments, dyes, chromogens, spin labels, and fluorescent labels. The label can also be, for example, a chemiluminescent substance; a metal-containing substance; or an enzyme, where there occurs an enzyme-dependent secondary generation of signal. The term "label" can also refer to a "tag" or hapten that can bind selectively to a conjugated molecule such that the conjugated molecule, when added subsequently along with a substrate, is used to generate a detectable signal. For example, biotin can be used as a tag along with an avidin or streptavidin conjugate of horseradish peroxidate (HRP) to bind to the tag, and examined using a calorimetric substrate (such as, for example, tetramethylbenzidine (TMB)) or a fluorogenic substrate to detect the presence of HRP. Exemplary labels that can be used as tags to facilitate purification include, but are not limited to, myc, HA, FLAG or 3×FLAG, 6×His or polyhistidine, glutathione-S-transferase (GST), maltose binding protein, an epitope tag, or the Fc portion of immunoglobulin. Numerous labels include, for example, particles, fluorophores, haptens, enzymes and their calorimetric, fluorogenic and chemiluminescent substrates and other labels.

The disclosed nucleic acid molecules can comprise, for example, nucleotides or non-natural or modified nucleotides, such as nucleotide analogs or nucleotide substitutes. Such nucleotides include a nucleotide that contains a modified base, sugar, or phosphate group, or that incorporates a non-natural moiety in its structure. Examples of non-natural nucleotides include, but are not limited to, dideoxynucleotides, biotinylated, aminated, deaminated, alkylated, benzylated, and fluorophor-labeled nucleotides.

The nucleic acid molecules disclosed herein can also comprise one or more nucleotide analogs or substitutions. A nucleotide analog is a nucleotide which contains a modification to either the base, sugar, or phosphate moieties. Modifications to the base moiety include, but are not limited to, natural and synthetic modifications of A, C, G, and T/U, as well as different purine or pyrimidine bases such as, for example, pseudouridine, uracil-5-yl, hypoxanthin-9-yl (I), and 2-aminoadenin-9-yl. Modified bases include, but are not limited to, 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo (such as, for example, 5-bromo), 5-trifluoromethyl and other 5-substituted uracils and cytosines, 7-methylguanine, 7-methyladenine, 8-azaguanine, 8-azaadenine, 7-deazaguanine, 7-deazaadenine, 3-deazaguanine, and 3-deazaadenine.

Nucleotide analogs can also include modifications of the sugar moiety. Modifications to the sugar moiety include, but are not limited to, natural modifications of the ribose and deoxy ribose as well as synthetic modifications. Sugar modifications include, but are not limited to, the following modifications at the 2' position: OH; F; O-, S-, or N-alkyl; O-, S-, or N-alkenyl; O-, S- or N-alkynyl; or O-alkyl-O-alkyl, wherein the alkyl, alkenyl, and alkynyl may be substituted or unsubstituted $C_{1-10}$ alkyl or $C_{2-10}$ alkenyl, and $C_{2-10}$ alkynyl. Exemplary 2' sugar modifications also include, but are not limited to, $—O[(CH_2)_nO]_mCH_3$, $—O(CH_2)_nOCH_3$, $—O(CH_2)_nNH_2$, $—O(CH_2)_nCH_3$, $—O(CH_2)_n—ONH_2$, and $—O(CH_2)_nON[(CH_2)_nCH_3)]_2$, where n and m are from 1 to about 10. Other modifications at the 2' position include, but are not limited to, $C_{1-10}$ alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. Similar modifications may also be made at other positions on the sugar, particularly the 3' position of the sugar on the 3' terminal nucleotide or in 2'-5' linked oligonucleotides and the 5' position of 5' terminal nucleotide. Modified sugars can also include those that contain modifications at the bridging ring oxygen, such as $CH_2$ and S. Nucleotide sugar analogs can also have sugar mimetics, such as cyclobutyl moieties in place of the pentofuranosyl sugar.

Nucleotide analogs can also be modified at the phosphate moiety. Modified phosphate moieties include, but are not limited to, those that can be modified so that the linkage between two nucleotides contains a phosphorothioate, chiral phosphorothioate, phosphorodithioate, phosphotriester, aminoalkylphosphotriester, methyl and other alkyl phosphonates including 3'-alkylene phosphonate and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates. These phosphate or modified phosphate linkage between two nucleotides can be through a 3'-5' linkage or a 2'-5' linkage, and the linkage can contain inverted polarity such as 3'-5' to 5'-3' or 2'-5' to 5'-2'. Various salts, mixed salts, and free acid forms are also included. Nucleotide substitutes also include peptide nucleic acids (PNAs).

The present disclosure also provides vectors comprising any one or more of the nucleic acid molecules disclosed herein. In some embodiments, the vectors comprise any one or more of the nucleic acid molecules disclosed herein and a heterologous nucleic acid. The vectors can be viral or nonviral vectors capable of transporting a nucleic acid molecule. In some embodiments, the vector is a plasmid or cosmid (such as, for example, a circular double-stranded DNA into which additional DNA segments can be ligated). In some embodiments, the vector is a viral vector, wherein additional DNA segments can be ligated into the viral genome. Expression vectors include, but are not limited to, plasmids, cosmids, retroviruses, adenoviruses, adeno-associated viruses (AAV), plant viruses such as cauliflower mosaic virus and tobacco mosaic virus, yeast artificial chromosomes (YACs), Epstein-Barr (EBV)-derived episomes, and other expression vectors known in the art.

Desired regulatory sequences for mammalian host cell expression can include, for example, viral elements that direct high levels of polypeptide expression in mammalian cells, such as promoters and/or enhancers derived from retroviral LTRs, cytomegalovirus (CMV) (such as, for example, CMV promoter/enhancer), Simian Virus 40 (SV40) (such as, for example, SV40 promoter/enhancer), adenovirus, (such as, for example, the adenovirus major late promoter (AdMLP)), polyoma and strong mammalian promoters such as native immunoglobulin and actin promoters. Methods of expressing polypeptides in bacterial cells or fungal cells (such as, for example, yeast cells) are also well known. A promoter can be, for example, a constitutively active promoter, a conditional promoter, an inducible promoter, a temporally restricted promoter (such as, for example, a developmentally regulated promoter), or a spatially restricted promoter (such as, for example, a cell-specific or tissue-specific promoter).

Percent identity (or percent complementarity) between particular stretches of nucleotide sequences within nucleic acid molecules or amino acid sequences within polypeptides can be determined routinely using BLAST programs (basic local alignment search tools) and PowerBLAST programs (Altschul et al., J. Mol. Biol., 1990, 215, 403-410; Zhang and Madden, Genome Res., 1997, 7, 649-656) or by using the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482-489). Herein, if reference is made to percent sequence identity, the higher percentages of sequence identity are preferred over the lower ones.

The present disclosure also provides compositions comprising any one or more of the isolated nucleic acid molecules, genomic nucleic acid molecules, mRNA molecules, and/or cDNA molecules disclosed herein. In some embodiments, the composition is a pharmaceutical composition. In some embodiments, the compositions comprise a carrier and/or excipient. Examples of carriers include, but are not limited to, poly(lactic acid) (PLA) microspheres, poly(D,L-lactic-coglycolic-acid) (PLGA) microspheres, liposomes, micelles, inverse micelles, lipid cochleates, and lipid microtubules. A carrier may comprise a buffered salt solution such as PBS, HBSS, etc.

As used herein, the phrase "corresponding to" or grammatical variations thereof when used in the context of the numbering of a particular nucleotide or nucleotide sequence or position refers to the numbering of a specified reference sequence when the particular nucleotide or nucleotide sequence is compared to a reference sequence (such as, for example, SEQ ID NO:1, SEQ ID NO:4, SEQ ID NO:5, SEQ ID NO:6, SEQ ID NO:7, SEQ ID NO:8, SEQ ID NO:9, SEQ ID NO:10, SEQ ID NO:11, or SEQ ID NO:28, SEQ ID NO:29, SEQ ID NO:30, SEQ ID NO:31, SEQ ID NO:32, SEQ ID NO:33, SEQ ID NO:34, or SEQ ID NO:35). In other words, the residue (such as, for example, nucleotide or amino acid) number or residue (such as, for example, nucleotide or amino acid) position of a particular polymer is designated with respect to the reference sequence rather than by the actual numerical position of the residue within the particular nucleotide or nucleotide sequence. For example, a particular nucleotide sequence can be aligned to a reference sequence by introducing gaps to optimize residue matches between the two sequences. In these cases, although the gaps are present, the numbering of the residue in the particular nucleotide or nucleotide sequence is made with respect to the reference sequence to which it has been aligned.

For example, a nucleic acid molecule comprising a nucleotide sequence encoding a human SOS2 polypeptide, wherein the nucleotide sequence comprises a guanine at a position corresponding to position 42,940 according to SEQ ID NO:2 means that if the nucleotide sequence of the SOS2 genomic nucleic acid molecule is aligned to the sequence of SEQ ID NO:2, the SOS2 sequence has a guanine residue at the position that corresponds to position 42,940 of SEQ ID NO:2. The same applies for mRNA molecules comprising a nucleotide sequence encoding a human SOS2 polypeptide, wherein the nucleotide sequence comprises a guanine at a position corresponding to position 598 according to SEQ ID NO:12, and cDNA molecules comprising a nucleotide sequence encoding a human SOS2 polypeptide, wherein the nucleotide sequence comprises a guanine at a position corresponding to position 598 according to SEQ ID NO:36. In other words, these phrases refer to a nucleic acid molecule encoding an SOS2 polypeptide, wherein the genomic nucleic acid molecule has a nucleotide sequence that comprises a guanine residue that is homologous to the guanine residue at position 42,940 of SEQ ID NO:2 (or wherein the mRNA molecule has a nucleotide sequence that comprises a guanine residue that is homologous to the guanine residue at position 598 of SEQ ID NO:12, or wherein the cDNA molecule has a nucleotide sequence that comprises a guanine residue that is homologous to the guanine residue at position 598 of SEQ ID NO:36). Herein, such a sequence is also referred to as "SOS2 sequence with the Pro191Arg (Isoform 1) alteration" or "SOS2 sequence with the Pro191Arg (Isoform 1) variation" referring to genomic nucleic acid molecules (or "SOS2 sequence with the C598G alteration" or "SOS2 sequence with the C598G variation" referring to mRNA molecules and/or cDNA molecules).

As described herein, a position within an SOS2 genomic nucleic acid molecule that corresponds to position 42,940 according to SEQ ID NO:2, for example, can be identified by performing a sequence alignment between the nucleotide sequence of a particular SOS2 nucleic acid molecule and the nucleotide sequence of SEQ ID NO:2. A variety of computational algorithms exist that can be used for performing a sequence alignment to identify a nucleotide position that corresponds to, for example, position 42,940 in SEQ ID NO:2. For example, by using the NCBI BLAST algorithm (Altschul et al., Nucleic Acids Res., 1997, 25, 3389-3402) or CLUSTALW software (Sievers and Higgins, Methods Mol. Biol., 2014, 1079, 105-116) sequence alignments may be performed. However, sequences can also be aligned manually.

The amino acid sequences of SOS2 reference polypeptides are set forth in SEQ ID NO:52 (Isoform 1), SEQ ID NO:53 (Isoform 2), and SEQ ID NO:54 (Isoform 3). Referring to SEQ ID NO:52 (Isoform 1), the SOS2 reference polypeptide is 1,332 amino acids in length. Referring to SEQ ID NO:52 (Isoform 1), position 191 is proline, and position 208 is alanine. Referring to SEQ ID NO:53 (Isoform 2), the SOS2 reference polypeptide is 1,299 amino acids in length. Referring to SEQ ID NO:53 (Isoform 2), position 191 is proline, and position 208 is alanine. Referring to SEQ ID NO:54 (Isoform 3), the SOS2 reference polypeptide is 1,231 amino acids in length. Referring to SEQ ID NO:54 (Isoform 3), position 221 is proline, and position 238 is alanine.

A first set of SOS2 variant polypeptides exists, wherein the proline at the positions referred to above for the SOS2 reference polypeptides is replaced by an arginine. Referring to SEQ ID NO:55 (Pro191Arg-Isoform 1), position 191 is an arginine. Referring to SEQ ID NO:57 (Pro191Arg-Isoform 2), position 191 is an arginine. Referring to SEQ ID NO:59 (Pro221Arg-Isoform 3), position 221 is an arginine.

A second set of SOS2 variant polypeptides exists, wherein the alanine at the positions referred to above for the SOS2 reference polypeptides is replaced by a threonine. Referring to SEQ ID NO:56 (Ala208Thr-Isoform 1), position 208 is a threonine. Referring to SEQ ID NO:58 (Ala208Thr-Isoform 2), position 208 is a threonine. Referring to SEQ ID NO:60 (Ala238Thr-Isoform 3), position 238 is a threonine.

The nucleotide and amino acid sequences listed in the accompanying sequence listing are shown using standard letter abbreviations for nucleotide bases, and three-letter code for amino acids. The nucleotide sequences follow the standard convention of beginning at the 5' end of the sequence and proceeding forward (i.e., from left to right in each line) to the 3' end. Only one strand of each nucleotide sequence is shown, but the complementary strand is understood to be included by any reference to the displayed strand. The amino acid sequence follows the standard convention of beginning at the amino terminus of the sequence and proceeding forward (i.e., from left to right in each line) to the carboxy terminus.

The present disclosure also provides therapeutic agents that treat or inhibit an ophthalmic condition for use in the treatment of an ophthalmic condition (or for use in the preparation of a medicament for treating an ophthalmic condition) in a human subject, wherein the human subject has any of the genomic nucleic acid molecules, mRNA molecules, and/or cDNA molecules encoding a human SOS2 polypeptide described herein. The therapeutic agents that treat or inhibit an ophthalmic condition can be any of the therapeutic agents that treat or inhibit an ophthalmic condition described herein.

In some embodiments, the human subject comprises: a genomic nucleic acid molecule having a nucleotide sequence encoding a human SOS2 polypeptide, wherein the nucleotide sequence comprises a guanine at a position corresponding to position 42,940 according to SEQ ID NO:2, or the complement thereof; an mRNA molecule having a nucleotide sequence encoding a human SOS2 polypeptide, wherein the nucleotide sequence comprises: a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; a cDNA molecule having a nucleotide sequence encoding a human SOS2 polypeptide, wherein the nucleotide sequence comprises: a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50, or the complement thereof; or an SOS2 polypeptide that comprises: an arginine at a position corresponding to position 191 according to SEQ ID NO:55, an arginine at a position corresponding to position 191 according to SEQ ID NO:57, or an arginine at a position corresponding to position 221 according to SEQ ID NO:59.

In some embodiments, the human subject comprises: a genomic nucleic acid molecule having a nucleotide sequence encoding a human SOS2 polypeptide, wherein the nucleotide sequence comprises an adenine at a position corresponding to position 42,990 according to SEQ ID NO:3, or the complement thereof; an mRNA molecule having a nucleotide sequence encoding a human SOS2 polypeptide, wherein the nucleotide sequence comprises: an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; a cDNA molecule having a nucleotide sequence encoding a human SOS2 polypeptide, wherein the nucleotide sequence comprises: an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof or an SOS2 polypeptide that comprises a threonine at a position corresponding to position 208 according to SEQ ID NO:56, a threonine at a position corresponding to position 208 according to SEQ ID NO:58, or a threonine at a position corresponding to position 238 according to SEQ ID NO:60.

The present disclosure also provides SOS2 inhibitors for use in the treatment of an ophthalmic condition (or for use in the preparation of a medicament for treating an ophthalmic condition) in a human subject, wherein the human subject has any of the genomic nucleic acid molecules, mRNA molecules, and/or cDNA molecules encoding a human SOS2 polypeptide described herein. The SOS2 inhibitors can be any of the SOS2 inhibitors described herein.

In some embodiments, the human subject comprises: a genomic nucleic acid molecule having a nucleotide sequence encoding a human SOS2 polypeptide, wherein the nucleotide sequence comprises a guanine at a position corresponding to position 42,940 according to SEQ ID NO:2, or the complement thereof; an mRNA molecule having a nucleotide sequence encoding a human SOS2 polypeptide, wherein the nucleotide sequence comprises: a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; a cDNA molecule having a nucleotide sequence encoding a human SOS2 polypeptide, wherein the nucleotide sequence comprises: a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50, or the complement thereof; or an SOS2 polypeptide that comprises: an arginine at a position corresponding to position 191 according to SEQ ID NO:55, an arginine at a position corresponding to position 191 according to SEQ ID NO:57, or an arginine at a position corresponding to position 221 according to SEQ ID NO:59.

In some embodiments, the human subject comprises: a genomic nucleic acid molecule having a nucleotide sequence encoding a human SOS2 polypeptide, wherein the nucleotide sequence comprises an adenine at a position corresponding to position 42,990 according to SEQ ID NO:3, or the complement thereof; an mRNA molecule having a nucleotide sequence encoding a human SOS2 polypeptide, wherein the nucleotide sequence comprises: an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; a cDNA molecule having a nucleotide sequence encoding a human SOS2 polypeptide, wherein the nucleotide sequence comprises: an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof or an SOS2 polypeptide that comprises a threonine at a position corresponding to position 208 according to SEQ ID NO:56, a threonine at a position corresponding to position 208 according to SEQ ID NO:58, or a threonine at a position corresponding to position 238 according to SEQ ID NO:60.

All patent documents, websites, other publications, accession numbers and the like cited above or below are incorporated by reference in their entirety for all purposes to the same extent as if each individual item were specifically and individually indicated to be so incorporated by reference. If different versions of a sequence are associated with an accession number at different times, the version associated with the accession number at the effective filing date of this application is meant. The effective filing date means the earlier of the actual filing date or filing date of a priority application referring to the accession number if applicable. Likewise, if different versions of a publication, website or the like are published at different times, the version most recently published at the effective filing date of the application is meant unless otherwise indicated. Any feature, step, element, embodiment, or aspect of the present disclosure can be used in combination with any other feature, step, element, embodiment, or aspect unless specifically indicated otherwise. Although the present disclosure has been described in some detail by way of illustration and example for purposes of clarity and understanding, it will be apparent that certain changes and modifications may be practiced within the scope of the appended claims.

The following representative embodiments are presented:

Embodiment 1. A method of treating a patient having an ophthalmic condition, the method comprising administering an SOS2 inhibitor to the patient.

Embodiment 2. A method of treating a patient having increased IOP, the method comprising administering an SOS2 inhibitor to the patient.

Embodiment 3. A method of treating a patient having glaucoma, the method comprising administering an SOS2 inhibitor to the patient.

Embodiment 4. A method of treating a patient having pre-glaucoma, the method comprising administering an SOS2 inhibitor to the patient.

Embodiment 5. A method of treating a patient having decreased corneal hysteresis, the method comprising administering an SOS2 inhibitor to the patient.

Embodiment 6. The method according to any one of embodiments 1 to 5, wherein the SOS2 inhibitor comprises an antisense nucleic acid molecule, a small interfering RNA (siRNA), or a short hairpin RNA (shRNA) that hybridizes to an SOS2 mRNA.

Embodiment 7. The method according to any one of embodiments 1 to 5, wherein the SOS2 inhibitor comprises a Cas protein and guide RNA (gRNA) that hybridizes to a gRNA recognition sequence within an SOS2 genomic nucleic acid molecule.

Embodiment 8. The method according to embodiment 7, wherein the Cas protein is Cas9 or Cpf1.

Embodiment 9. The method according to embodiment 7 or embodiment 8, wherein the gRNA recognition sequence includes or is proximate to a position corresponding to position 42,940 according to SEQ ID NO:1, or position 42,990 according to SEQ ID NO:1.

Embodiment 10. The method according to embodiment 7 or embodiment 8, wherein the gRNA recognition sequence is located from about 1000, from about 500, from about 400, from about 300, from about 200, from about 100, from about 50, from about 45, from about 40, from about 35, from about 30, from about 25, from about 20, from about 15, from about 10, or from about 5 nucleotides of a position corresponding to position 42,940 according to SEQ ID NO:1, or position 42,990 according to SEQ ID NO:1.

Embodiment 11. The method according to embodiment 7 or embodiment 8, wherein a Protospacer Adjacent Motif (PAM) sequence is about 2 to about 6 nucleotides downstream of the gRNA recognition sequence.

Embodiment 12. The method according to any one of embodiments 7 to 11, wherein the gRNA comprises from about 17 to about 23 nucleotides.

Embodiment 13. The method according to any one of embodiments 7 to 11, wherein the gRNA recognition sequence comprises a nucleotide sequence according to any one of SEQ ID NOS:61-71.

Embodiment 14. The method according to any one of embodiments 1 to 13, further comprising detecting the presence or absence of an SOS2 predicted loss-of-function variant nucleic acid molecule encoding a human SOS2 polypeptide in a biological sample from the patient.

Embodiment 15. The method according to embodiment 14, wherein when the patient is SOS2 reference, the patient is also administered a therapeutic agent that treats or inhibits an ophthalmic condition in a standard dosage amount.

Embodiment 16. The method according to embodiment 14, wherein when the patient is heterozygous for an SOS2 predicted loss-of-function variant, the patient is also administered a therapeutic agent that treats or inhibits an ophthalmic condition in a dosage amount that is the same as or lower than a standard dosage amount.

Embodiment 17. The method according to any one of embodiments 14 to 16, wherein the SOS2 predicted loss-of-function variant nucleic acid molecule is a nucleic acid molecule encoding SOS2 Pro191Arg (Isoform 1), SOS2 Ala208Thr (Isoform 1), SOS2 Pro191Arg (Isoform 2), SOS2 Ala208Thr (Isoform 2), SOS2 Pro221Arg, or SOS2 Ala238Thr.

Embodiment 18. The method according to any one of embodiments 14 to 16, wherein the SOS2 predicted loss-of-function variant nucleic acid molecule is a nucleic acid molecule encoding SOS2 Pro191Arg (Isoform 1) or SOS2 Ala208Thr (Isoform 1).

Embodiment 19. The method according to embodiment 17, wherein the SOS2 predicted loss-of-function variant nucleic acid molecule is: a genomic nucleic acid molecule having a nucleotide sequence comprising a guanine at a position corresponding to position 42,940 according to SEQ ID NO:2, or an adenine at a position corresponding to position 42,990 according to SEQ ID NO:3; an mRNA molecule having a nucleotide sequence comprising: a guanine at a position corresponding to position 598 according to SEQ ID NO:12, a guanine at a position corresponding to position 598 according to SEQ ID NO:14, a guanine at a position corresponding to position 598 according to SEQ ID NO:16, a guanine at a position corresponding to position 572 according to SEQ ID NO:18, a guanine at a position corresponding to position 591 according to SEQ ID NO:20, a guanine at a position corresponding to position 640 according to SEQ ID NO:22, a guanine at a position corresponding to position 581 according to SEQ ID NO:24, or a guanine at a position corresponding to position 662 according to SEQ ID NO:26; or an adenine at a position corresponding to position 648 according to SEQ ID NO:13, an adenine at a position corresponding to position 648 according to SEQ ID NO:15, an adenine at a position corresponding to position 648 according to SEQ ID NO:17, an adenine at a position corresponding to position 622 according to SEQ ID NO:19, an adenine at a position corresponding to position 641 according to SEQ ID NO:21, an adenine at a position corresponding to position 690 according to SEQ ID NO:23, an adenine at a position corresponding to position 631 according to SEQ ID NO:25, or an adenine at a position corresponding to position 712 according to SEQ ID NO:27; a cDNA molecule produced from an mRNA molecule, wherein the cDNA molecule has a nucleotide sequence comprising: a guanine at a position corresponding to position 598 according to SEQ ID NO:36, a guanine at a position corresponding to position 598 according to SEQ ID NO:38, a guanine at a position corresponding to position 598 according to SEQ ID NO:40, a guanine at a position corresponding to position 572 according to SEQ ID NO:42, a guanine at a position corresponding to position 591 according to SEQ ID NO:44, a guanine at a position corresponding to position 640 according to SEQ ID NO:46, a guanine at a position corresponding to position 581 according to SEQ ID NO:48, or a guanine at a position corresponding to position 662 according to SEQ ID NO:50; or an adenine at a position corresponding to position 648 according to SEQ ID NO:37, an adenine at a position corresponding to position 648 according to SEQ ID NO:39, an adenine at a position corresponding to position 648 according to SEQ ID NO:41, an adenine at a position corresponding to position 622 according to SEQ ID NO:43, an adenine at a position corresponding to position 641 according to SEQ ID NO:45, an adenine at a position corresponding to position 690 according to SEQ ID NO:47, an adenine at a position corresponding to position 631 according to SEQ ID NO:49, or an adenine at a position corresponding to position 712 according to SEQ ID NO:51.

Embodiment 20. The method according to any one of embodiments 14 to 19, wherein the detecting step is carried out in vitro.

Embodiment 21. The method according to any one of embodiments 14 to 20, wherein the detecting step comprises sequencing at least a portion of the nucleotide sequence of the SOS2 genomic nucleic acid molecule in the biological sample, wherein the sequenced portion comprises a position corresponding to: position 42,940 according to SEQ ID NO:2, or the complement thereof; or position 42,990 according to SEQ ID NO:3, or the complement thereof; wherein when the sequenced portion of the SOS2 genomic nucleic acid molecule in the biological sample comprises: a guanine at a position corresponding to position 42,940 according to SEQ ID NO:2, or an adenine at a position corresponding to position 42,990 according to SEQ ID NO:3, then the SOS2 genomic nucleic acid molecule in the biological sample is an SOS2 predicted loss-of-function variant genomic nucleic acid molecule.

Embodiment 22. The method according to any one of embodiments 14 to 20, wherein the detecting step comprises sequencing at least a portion of the nucleotide sequence of the SOS2 mRNA molecule in the biological sample, wherein the sequenced portion comprises a position corresponding to: position 598 according to SEQ ID NO:12, or the complement thereof; position 598 according to SEQ ID NO:14, or the complement thereof; position 598 according to SEQ ID NO:16, or the complement thereof; position 572 according to SEQ ID NO:18, or the complement thereof; position 591 according to SEQ ID NO:20, or the complement thereof; position 640 according to SEQ ID NO:22, or the complement thereof; position 581 according to SEQ ID NO:24, or the complement thereof; or position 662 according to SEQ ID NO:26, or the complement thereof; position 648 according to SEQ ID NO:13, or the complement thereof; position 648 according to SEQ ID NO:15, or the complement thereof; position 648 according to SEQ ID NO:17, or the complement thereof; position 622 according to SEQ ID NO:19, or the complement thereof; position 641 according to SEQ ID NO:21, or the complement thereof; position 690 according to SEQ ID NO:23, or the complement thereof; position 631 according to SEQ ID NO:25, or the complement thereof; or position 712 according to SEQ ID NO:27, or the complement thereof; wherein when the sequenced portion of the SOS2 mRNA molecule in the biological sample comprises: a guanine at a position corresponding to position 598 according to SEQ ID NO:12, a guanine at a position corresponding to position 598 according to SEQ ID NO:14, a guanine at a position corresponding to position 598 according to SEQ ID NO:16, a guanine at a position corresponding to position 572 according to SEQ ID NO:18, a guanine at a position corresponding to position 591 according to SEQ ID NO:20, a guanine at a position corresponding to position 640 according to SEQ ID NO:22, a guanine at a position corresponding to position 581 according to SEQ ID NO:24, or a guanine at a position corresponding to position 662 according to SEQ ID NO:26; or an adenine at a position corresponding to position 648 according to SEQ ID NO:13, an adenine at a position corresponding to position 648 according to SEQ ID NO:15, an adenine at a position corresponding to position 648 according to SEQ ID NO:17, an adenine at a position corresponding to position 622 according to SEQ ID NO:19, an adenine at a position corresponding to position 641 according to SEQ ID NO:21, an adenine at a position corresponding to position 690 according to SEQ ID NO:23, an adenine at a position corresponding to position 631 according to SEQ ID NO:25, or an adenine at a position corresponding to position 712 according to SEQ ID NO:27; then the SOS2 mRNA molecule in the biological sample is an SOS2 predicted loss-of-function variant mRNA molecule.

Embodiment 23. The method according to any one of embodiments 14 to 20, wherein the detecting step comprises sequencing at least a portion of the nucleotide sequence of the SOS2 cDNA molecule produced from an mRNA molecule in the biological sample, wherein the sequenced portion comprises a position corresponding to: position 598 according to SEQ ID NO:36, or the complement thereof; position 598 according to SEQ ID NO:38, or the complement thereof; position 598 according to SEQ ID NO:40, or the complement thereof; position 572 according to SEQ ID NO:42, or the complement thereof; position 591 according to SEQ ID NO:44, or the complement thereof; position 640 according to SEQ ID NO:46, or the complement thereof; position 581 according to SEQ ID NO:48, or the complement thereof; or position 662 according to SEQ ID NO:50, or the complement thereof; or position 648 according to SEQ ID NO:37, or the complement thereof; position 648 according to SEQ ID NO:39, or the complement thereof; position 648 according to SEQ ID NO:41, or the complement thereof; position 622 according to SEQ ID NO:43, or the complement thereof; position 641 according to SEQ ID NO:45, or the complement thereof; position 690 according to SEQ ID NO:47, or the complement thereof; position 631 according to SEQ ID NO:49, or the complement thereof; position 712 according to SEQ ID NO:51; wherein when the sequenced portion of the SOS2 cDNA molecule in the biological sample comprises: a guanine at a position corresponding to position 598 according to SEQ ID NO:36, a guanine at a position corresponding to position 598 according to SEQ ID NO:38, a guanine at a position corresponding to position 598 according to SEQ ID NO:40, a guanine at a position corresponding to position 572 according to SEQ ID NO:42, a guanine at a position corresponding to position 591 according to SEQ ID NO:44, a guanine at a position corresponding to position 640 according to SEQ ID NO:46, a guanine at a position corresponding to position 581 according to SEQ ID NO:48, or a guanine at a position corresponding to position 662 according to SEQ ID NO:50; or an adenine at a position corresponding to position 648 according to SEQ ID NO:37, an adenine at a position corresponding to position 648 according to SEQ ID NO:39, an adenine at a position corresponding to position 648 according to SEQ ID NO:41, an adenine at a position corresponding to position 622 according to SEQ ID NO:43, an adenine at a position corresponding to position 641 according to SEQ ID NO:45, an adenine at a position corresponding to position 690 according to SEQ ID NO:47, an adenine at a position corresponding to position 631 according to SEQ ID NO:49, or an adenine at a position corresponding to position 712 according to SEQ ID NO:51; then the SOS2 cDNA molecule in the biological sample is an SOS2 predicted loss-of-function variant cDNA molecule.

Embodiment 24. The method according to any one of embodiments 14 to 20, wherein the detecting step comprises: a) contacting the biological sample with a primer hybridizing to a portion of the nucleotide sequence of the SOS2 genomic nucleic acid molecule that is proximate to a position corresponding to: position 42,940 according to SEQ ID NO:2, or position 42,990 according to SEQ ID NO:3; b) extending the primer at least through the position of the nucleotide sequence of the SOS2 genomic nucleic acid molecule corresponding to: position 42,940 according to SEQ ID NO:2, or position 42,990 according to SEQ ID NO:3; and c) determining whether the extension product of the primer comprises: a guanine at a position corresponding to position 42,940 according to SEQ ID NO:2, or an adenine at a position corresponding to position 42,990 according to SEQ ID NO:3.

Embodiment 25. The method according to any one of embodiments 14 to 20, wherein the detecting step comprises: a) contacting the biological sample with a primer hybridizing to a portion of the nucleotide sequence of the SOS2 mRNA molecule that is proximate to a position corresponding to: position 598 according to SEQ ID NO:12, position 598 according to SEQ ID NO:14, position 598 according to SEQ ID NO:16, position 572 according to SEQ ID NO:18, position 591 according to SEQ ID NO:20, position 640 according to SEQ ID NO:22, position 581 according to SEQ ID NO:24, or position 662 according to SEQ ID NO:26; or position 648 according to SEQ ID NO:13, position 648 according to SEQ ID NO:15, position 648 according to SEQ ID NO:17, position 622 according to SEQ ID NO:19, position 641 according to SEQ ID NO:21, position 690 according to SEQ ID NO:23, position 631 according to SEQ ID NO:25, or position 712 according to SEQ ID NO:27; b) extending the primer at least through the position of the nucleotide sequence of the SOS2 mRNA molecule corresponding to: position 598 according to SEQ ID NO:12, position 598 according to SEQ ID NO:14, position 598 according to SEQ ID NO:16, position 572 according to SEQ ID NO:18, position 591 according to SEQ ID NO:20, position 640 according to SEQ ID NO:22, position 581 according to SEQ ID NO:24, or position 662 according to SEQ ID NO:26; or position 648 according to SEQ ID NO:13, position 648 according to SEQ ID NO:15, position 648 according to SEQ ID NO:17, position 622 according to SEQ ID NO:19, position 641 according to SEQ ID NO:21, position 690 according to SEQ ID NO:23, position 631 according to SEQ ID NO:25, or position 712 according to SEQ ID NO:27; and c) determining whether the extension product of the primer comprises: a guanine at a position corresponding to position 598 according to SEQ ID NO:12, a guanine at a position corresponding to position 598 according to SEQ ID NO:14, a guanine at a position corresponding to position 598 according to SEQ ID NO:16, a guanine at a position corresponding to position 572 according to SEQ ID NO:18, a guanine at a position corresponding to position 591 according to SEQ ID NO:20, a guanine at a position corresponding to position 640 according to SEQ ID NO:22, a guanine at a position corresponding to position 581 according to SEQ ID NO:24, or a guanine at a position corresponding to position 662 according to SEQ ID NO:26; or an adenine at a position corresponding to position 648 according to SEQ ID NO:13, an adenine at a position corresponding to position 648 according to SEQ ID NO:15, an adenine at a position corresponding to position 648 according to SEQ ID NO:17, an adenine at a position corresponding to position 622 according to SEQ ID NO:19, an adenine at a position corresponding to position 641 according to SEQ ID NO:21, an adenine at a position corresponding to position 690 according to SEQ ID NO:23, an adenine at a position corresponding to position 631 according to SEQ ID NO:25, or an adenine at a position corresponding to position 712 according to SEQ ID NO:27.

Embodiment 26. The method according to any one of embodiments 14 to 20, wherein the detecting step comprises: a) contacting the biological sample with a primer hybridizing to a portion of the nucleotide sequence of the SOS2 cDNA molecule that is proximate to a position corresponding to: position 598 according to SEQ ID NO:36, position 598 according to SEQ ID NO:38, position 598 according to SEQ ID NO:40, position 572 according to SEQ ID NO:42, position 591 according to SEQ ID NO:44, position 640 according to SEQ ID NO:46, position 581 according to SEQ ID NO:48, or position 662 according to SEQ ID NO:50; or position 648 according to SEQ ID NO:37, position 648 according to SEQ ID NO:39, position 648 according to SEQ ID NO:41, position 622 according to SEQ ID NO:43, position 641 according to SEQ ID NO:45, position 690 according to SEQ ID NO:47, position 631 according to SEQ ID NO:49, or position 712 according to SEQ ID NO:51; b) extending the primer at least through the position of the nucleotide sequence of the SOS2 cDNA molecule corresponding to: position 598 according to SEQ ID NO:36, position 598 according to SEQ ID NO:38, position 598 according to SEQ ID NO:40, position 572 according to SEQ ID NO:42, position 591 according to SEQ ID NO:44, position 640 according to SEQ ID NO:46, position 581 according to SEQ ID NO:48, or position 662 according to SEQ ID NO:50; or position 648 according to SEQ ID NO:37, position 648 according to SEQ ID NO:39, position 648 according to SEQ ID NO:41, position 622 according to SEQ ID NO:43, position 641 according to SEQ ID NO:45, position 690 according to SEQ ID NO:47, position 631 according to SEQ ID NO:49, or position 712 according to SEQ ID NO:51; and c) determining whether the extension product of the primer comprises: a guanine at a position corresponding to position 598 according to SEQ ID NO:36, a guanine at a position corresponding to position 598 according to SEQ ID NO:38, a guanine at a position corresponding to position 598 according to SEQ ID NO:40, a guanine at a position corresponding to position 572 according to SEQ ID NO:42, a guanine at a position corresponding to position 591 according to SEQ ID NO:44, a guanine at a position corresponding to position 640 according to SEQ ID NO:46, a guanine at a position corresponding to position 581 according to SEQ ID NO:48, or a guanine at a position corresponding to position 662 according to SEQ ID NO:50; or an adenine at a position corresponding to position 648 according to SEQ ID NO:37, an adenine at a position corresponding to position 648 according to SEQ ID NO:39, an adenine at a position corresponding to position 648 according to SEQ ID NO:41, an adenine at a position corresponding to position 622 according to SEQ ID NO:43, an adenine at a position corresponding to position 641 according to SEQ ID NO:45, an adenine at a position corresponding to position 690 according to SEQ ID NO:47, an adenine at a position corresponding to position 631 according to SEQ ID NO:49, or an adenine at a position corresponding to position 712 according to SEQ ID NO:51.

Embodiment 27. The method according to any one of embodiments 21 to 26, wherein the detecting step comprises sequencing the entire nucleic acid molecule.

Embodiment 28. The method according to any one of embodiments 14 to 20, wherein the detecting step comprises: a) amplifying at least a portion of the nucleic acid molecule that encodes the human SOS2 polypeptide, wherein the portion comprises: a guanine at a position corresponding to position 42,940 according to SEQ ID NO:2, or the complement thereof; or an adenine at a position corresponding to position 42,990 according to SEQ ID NO:3, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: a guanine at a position corresponding to position 42,940 according to SEQ ID NO:2, or the complement thereof; or an adenine at a position corresponding to position 42,990 according to SEQ ID NO:3, or the complement thereof; and d) detecting the detectable label.

Embodiment 29. The method according to any one of embodiments 14 to 20, wherein the detecting step comprises: a) amplifying at least a portion of the nucleic acid molecule that encodes the human SOS2 polypeptide, wherein the portion comprises: a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; and d) detecting the detectable label.

Embodiment 30. The method according to any one of embodiments 14 to 20, wherein the detecting step comprises: a) amplifying at least a portion of the nucleic acid molecule that encodes the human SOS2 polypeptide, wherein the portion comprises: a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50, or the complement thereof; or an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50, or the complement thereof; or an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof; and d) detecting the detectable label.

Embodiment 31. The method according to embodiment 30, wherein the nucleic acid molecule in the sample is mRNA and the mRNA is reverse-transcribed into cDNA prior to the amplifying step.

Embodiment 32. The method according to any one of embodiments 14 to 20, wherein the detecting step comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: a guanine at a position corresponding to position 42,940 according to SEQ ID NO:2, or the complement thereof; or an adenine at a position corresponding to position 42,990 according to SEQ ID NO:3, or the complement thereof; and detecting the detectable label.

Embodiment 33. The method according to any one of embodiments 14 to 20, wherein the detecting step comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; and detecting the detectable label.

Embodiment 34. The method according to any one of embodiments 14 to 20, wherein the detecting step comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50, or the complement thereof; or an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof; and detecting the detectable label.

Embodiment 35. A method of treating a patient with a therapeutic agent that treats or inhibits an ophthalmic condition, wherein the patient is suffering from an ophthalmic condition, the method comprising the steps of: determining whether the patient has an SOS2 predicted loss-of-function variant nucleic acid molecule encoding a human SOS2 polypeptide by: obtaining or having obtained a biological sample from the patient; and performing or having performed a genotyping assay on the biological sample to determine if the patient has a genotype comprising the SOS2 predicted loss-of-function variant nucleic acid molecule; and when the patient is SOS2 reference, then administering or continuing to administer to the patient the therapeutic agent that treats or inhibits an ophthalmic condition in a standard dosage amount, and administering to the patient an SOS2 inhibitor; and when the patient is heterozygous for an SOS2 predicted loss-of-function variant, then administering or continuing to administer to the patient the therapeutic agent that treats or inhibits an ophthalmic condition in an amount that is the same as or lower than a standard dosage amount, and administering to the patient an SOS2 inhibitor; wherein the presence of a genotype having the SOS2 predicted loss-of-function variant nucleic acid molecule encoding the human SOS2 polypeptide indicates the patient has a reduced risk of developing an ophthalmic condition.

Embodiment 36. The method according to embodiment 35, wherein the patient is SOS2 reference, and the patient is administered or continued to be administered the therapeutic agent that treats or inhibits an ophthalmic condition in a standard dosage amount, and is administered an SOS2 inhibitor.

Embodiment 37. The method according to embodiment 35, wherein the patient is heterozygous for an SOS2 predicted loss-of-function variant, and the patient is administered or continued to be administered the therapeutic agent that treats or inhibits an ophthalmic condition in an amount that is the same as or lower than a standard dosage amount, and is administered an SOS2 inhibitor.

Embodiment 38. The method according to any one of embodiments 35 to 37, wherein the SOS2 predicted loss-of-function variant nucleic acid molecule is a nucleic acid molecule encoding SOS2 Pro191Arg (Isoform 1), SOS2 Ala208Thr (Isoform 1), SOS2 Pro191Arg (Isoform 2), SOS2 Ala208Thr (Isoform 2), SOS2 Pro221Arg, or SOS2 Ala238Thr.

Embodiment 39. The method according to any one of embodiments 35 to 37, wherein the SOS2 predicted loss-of-function variant nucleic acid molecule is a nucleic acid molecule encoding SOS2 Pro191Arg (Isoform 1) or SOS2 Ala208Thr (Isoform 1).

Embodiment 40. The method according to embodiment 38, wherein the SOS2 predicted loss-of-function variant nucleic acid molecule is: a genomic nucleic acid molecule having a nucleotide sequence comprising a guanine at a position corresponding to position 42,940 according to SEQ ID NO:2, or an adenine at a position corresponding to position 42,990 according to SEQ ID NO:3; an mRNA molecule having a nucleotide sequence comprising: a guanine at a position corresponding to position 598 according to SEQ ID NO:12, a guanine at a position corresponding to position 598 according to SEQ ID NO:14, a guanine at a position corresponding to position 598 according to SEQ ID NO:16, a guanine at a position corresponding to position 572 according to SEQ ID NO:18, a guanine at a position corresponding to position 591 according to SEQ ID NO:20, a guanine at a position corresponding to position 640 according to SEQ ID NO:22, a guanine at a position corresponding to position 581 according to SEQ ID NO:24, or a guanine at a position corresponding to position 662 according to SEQ ID NO:26; or an adenine at a position corresponding to position 648 according to SEQ ID NO:13, an adenine at a position corresponding to position 648 according to SEQ ID NO:15, an adenine at a position corresponding to position 648 according to SEQ ID NO:17, an adenine at a position corresponding to position 622 according to SEQ ID NO:19, an adenine at a position corresponding to position 641 according to SEQ ID NO:21, an adenine at a position corresponding to position 690 according to SEQ ID NO:23, an adenine at a position corresponding to position 631 according to SEQ ID NO:25, or an adenine at a position corresponding to position 712 according to SEQ ID NO:27; a cDNA molecule produced from an mRNA molecule, wherein the cDNA molecule has a nucleotide sequence comprising: a guanine at a position corresponding to position 598 according to SEQ ID NO:36, a guanine at a position corresponding to position 598 according to SEQ ID NO:38, a guanine at a position corresponding to position 598 according to SEQ ID NO:40, a guanine at a position corresponding to position 572 according to SEQ ID NO:42, a guanine at a position corresponding to position 591 according to SEQ ID NO:44, a guanine at a position corresponding to position 640 according to SEQ ID NO:46, a guanine at a position corresponding to position 581 according to SEQ ID NO:48, or a guanine at a position corresponding to position 662 according to SEQ ID NO:50; or an adenine at a position corresponding to position 648 according to SEQ ID NO:37, an adenine at a position corresponding to position 648 according to SEQ ID NO:39, an adenine at a position corresponding to position 648 according to SEQ ID NO:41, an adenine at a position corresponding to position 622 according to SEQ ID NO:43, an adenine at a position corresponding to position 641 according to SEQ ID NO:45, an adenine at a position corresponding to position 690 according to SEQ ID NO:47, an adenine at a position corresponding to position 631 according to SEQ ID NO:49, or an adenine at a position corresponding to position 712 according to SEQ ID NO:51.

Embodiment 41. The method according to any one of embodiments 35 to 40, wherein the genotyping assay comprises sequencing at least a portion of the nucleotide sequence of the SOS2 genomic nucleic acid molecule in the biological sample, wherein the sequenced portion comprises a position corresponding to: position 42,940 according to SEQ ID NO:2, or the complement thereof; or position 42,990 according to SEQ ID NO:3, or the complement thereof; wherein when the sequenced portion of the SOS2 genomic nucleic acid molecule in the biological sample comprises: a guanine at a position corresponding to position 42,940 according to SEQ ID NO:2, or an adenine at a position corresponding to position 42,990 according to SEQ ID NO:3, then the SOS2 genomic nucleic acid molecule in the biological sample is an SOS2 predicted loss-of-function variant genomic nucleic acid molecule.

Embodiment 42. The method according to any one of embodiments 35 to 40, wherein the genotyping assay comprises sequencing at least a portion of the nucleotide sequence of the SOS2 mRNA molecule in the biological sample, wherein the sequenced portion comprises a position corresponding to: position 598 according to SEQ ID NO:12, or the complement thereof; position 598 according to SEQ ID NO:14, or the complement thereof; position 598 according to SEQ ID NO:16, or the complement thereof; position 572 according to SEQ ID NO:18, or the complement thereof; position 591 according to SEQ ID NO:20, or the complement thereof; position 640 according to SEQ ID NO:22, or the complement thereof; position 581 according to SEQ ID NO:24, or the complement thereof; or position 662 according to SEQ ID NO:26, or the complement thereof; position 648 according to SEQ ID NO:13, or the complement thereof; position 648 according to SEQ ID NO:15, or the complement thereof; position 648 according to SEQ ID NO:17, or the complement thereof; position 622 according to SEQ ID NO:19, or the complement thereof; position 641 according to SEQ ID NO:21, or the complement thereof; position 690 according to SEQ ID NO:23, or the complement thereof; position 631 according to SEQ ID NO:25, or the complement thereof; or position 712 according to SEQ ID NO:27, or the complement thereof; wherein when the sequenced portion of the SOS2 mRNA molecule in the biological sample comprises: a guanine at a position corresponding to position 598 according to SEQ ID NO:12, a guanine at a position corresponding to position 598 according to SEQ ID NO:14, a guanine at a position corresponding to position 598 according to SEQ ID NO:16, a guanine at a position corresponding to position 572 according to SEQ ID NO:18, a guanine at a position corresponding to position 591 according to SEQ ID NO:20, a guanine at a position corresponding to position 640 according to SEQ ID NO:22, a guanine at a position corresponding to position 581 according to SEQ ID NO:24, or a guanine at a position corresponding to position 662 according to SEQ ID NO:26; or an adenine at a position corresponding to position 648 according to SEQ ID NO:13, an adenine at a position corresponding to position 648 according to SEQ ID NO:15, an adenine at a position corresponding to position 648 according to SEQ ID NO:17, an adenine at a position corresponding to position 622 according to SEQ ID NO:19, an adenine at a position corresponding to position 641 according to SEQ ID NO:21, an adenine at a position corresponding to position 690 according to SEQ ID NO:23, an adenine at a position corresponding to position 631 according to SEQ ID NO:25, or an adenine at a position corresponding to position 712 according to SEQ ID NO:27; then the SOS2 mRNA molecule in the biological sample is an SOS2 predicted loss-of-function variant mRNA molecule.

Embodiment 43. The method according to any one of embodiments 35 to 40, wherein the genotyping assay comprises sequencing at least a portion of the nucleotide sequence of the SOS2 cDNA molecule in the biological sample, wherein the sequenced portion comprises a position corresponding to: position 598 according to SEQ ID NO:36, or the complement thereof; position 598 according to SEQ ID NO:38, or the complement thereof; position 598 according to SEQ ID NO:40, or the complement thereof; position 572 according to SEQ ID NO:42, or the complement thereof; position 591 according to SEQ ID NO:44, or the complement thereof; position 640 according to SEQ ID NO:46, or the complement thereof; position 581 according to SEQ ID NO:48, or the complement thereof; or position 662 according to SEQ ID NO:50, or the complement thereof; or position 648 according to SEQ ID NO:37, or the complement thereof; position 648 according to SEQ ID NO:39, or the complement thereof; position 648 according to SEQ ID NO:41, or the complement thereof; position 622 according to SEQ ID NO:43, or the complement thereof; position 641 according to SEQ ID NO:45, or the complement thereof; position 690 according to SEQ ID NO:47, or the complement thereof; position 631 according to SEQ ID NO:49, or the complement thereof; position 712 according to SEQ ID NO:51; wherein when the sequenced portion of the SOS2 cDNA molecule in the biological sample comprises: a guanine at a position corresponding to position 598 according to SEQ ID NO:36, a guanine at a position corresponding to position 598 according to SEQ ID NO:38, a guanine at a position corresponding to position 598 according to SEQ ID NO:40, a guanine at a position corresponding to position 572 according to SEQ ID NO:42, a guanine at a position corresponding to position 591 according to SEQ ID NO:44, a guanine at a position corresponding to position 640 according to SEQ ID NO:46, a guanine at a position corresponding to position 581 according to SEQ ID NO:48, or a guanine at a position corresponding to position 662 according to SEQ ID NO:50; or an adenine at a position corresponding to position 648 according to SEQ ID NO:37, an adenine at a position corresponding to position 648 according to SEQ ID NO:39, an adenine at a position corresponding to position 648 according to SEQ ID NO:41, an adenine at a position corresponding to position 622 according to SEQ ID NO:43, an adenine at a position corresponding to position 641 according to SEQ ID NO:45, an adenine at a position corresponding to position 690 according to SEQ ID NO:47, an adenine at a position corresponding to position 631 according to SEQ ID NO:49, or an adenine at a position corresponding to position 712 according to SEQ ID NO:51; then the SOS2 cDNA molecule in the biological sample is an SOS2 predicted loss-of-function variant cDNA molecule.

Embodiment 44. The method according to any one of embodiments 35 to 40, wherein the genotyping assay comprises: a) contacting the biological sample with a primer hybridizing to a portion of the nucleotide sequence of the SOS2 genomic nucleic acid molecule that is proximate to a position corresponding to position 42,940 according to SEQ ID NO:2, or position 42,990 according to SEQ ID NO:3; b) extending the primer at least through the position of the nucleotide sequence of the SOS2 genomic nucleic acid molecule corresponding to position 42,940 according to SEQ ID NO:2, or position 42,990 according to SEQ ID NO:3; and c) determining whether the extension product of the primer comprises a guanine at a position corresponding to position 42,940 according to SEQ ID NO:2, or an adenine at a position corresponding to position 42,990 according to SEQ ID NO:3.

Embodiment 45. The method according to any one of embodiments 35 to 40, wherein the genotyping assay comprises: a) contacting the biological sample with a primer hybridizing to a portion of the nucleotide sequence of the SOS2 mRNA molecule that is proximate to a position corresponding to: position 598 according to SEQ ID NO:12, position 598 according to SEQ ID NO:14, position 598 according to SEQ ID NO:16, position 572 according to SEQ ID NO:18, position 591 according to SEQ ID NO:20, position 640 according to SEQ ID NO:22, position 581 according to SEQ ID NO:24, or position 662 according to SEQ ID NO:26; or position 648 according to SEQ ID NO:13, position 648 according to SEQ ID NO:15, position 648 according to SEQ ID NO:17, position 622 according to SEQ ID NO:19, position 641 according to SEQ ID NO:21, position 690 according to SEQ ID NO:23, position 631 according to SEQ ID NO:25, or position 712 according to SEQ ID NO:27; b) extending the primer at least through the position of the nucleotide sequence of the SOS2 mRNA molecule corresponding to: position 598 according to SEQ ID NO:12, position 598 according to SEQ ID NO:14, position 598 according to SEQ ID NO:16, position 572 according to SEQ ID NO:18, position 591 according to SEQ ID NO:20, position 640 according to SEQ ID NO:22, position 581 according to SEQ ID NO:24, or position 662 according to SEQ ID NO:26; or position 648 according to SEQ ID NO:13, position 648 according to SEQ ID NO:15, position 648 according to SEQ ID NO:17, position 622 according to SEQ ID NO:19, position 641 according to SEQ ID NO:21, position 690 according to SEQ ID NO:23, position 631 according to SEQ ID NO:25, or position 712 according to SEQ ID NO:27; and c) determining whether the extension product of the primer comprises: a guanine at a position corresponding to position 598 according to SEQ ID NO:12, a guanine at a position corresponding to position 598 according to SEQ ID NO:14, a guanine at a position corresponding to position 598 according to SEQ ID NO:16, a guanine at a position corresponding to position 572 according to SEQ ID NO:18, a guanine at a position corresponding to position 591 according to SEQ ID NO:20, a guanine at a position corresponding to position 640 according to SEQ ID NO:22, a guanine at a position corresponding to position 581 according to SEQ ID NO:24, or a guanine at a position corresponding to position 662 according to SEQ ID NO:26; or an adenine at a position corresponding to position 648 according to SEQ ID NO:13, an adenine at a position corresponding to position 648 according to SEQ ID NO:15, an adenine at a position corresponding to position 648 according to SEQ ID NO:17, an adenine at a position corresponding to position 622 according to SEQ ID NO:19, an adenine at a position corresponding to position 641 according to SEQ ID NO:21, an adenine at a position corresponding to position 690 according to SEQ ID NO:23, an adenine at a position corresponding to position 631 according to SEQ ID NO:25, or an adenine at a position corresponding to position 712 according to SEQ ID NO:27.

Embodiment 46. The method according to any one of embodiments 35 to 40, wherein the genotyping assay comprises: a) contacting the biological sample with a primer hybridizing to a portion of the nucleotide sequence of the SOS2 cDNA molecule that is proximate to a position corresponding to: position 598 according to SEQ ID NO:36, position 598 according to SEQ ID NO:38, position 598 according to SEQ ID NO:40, position 572 according to SEQ ID NO:42, position 591 according to SEQ ID NO:44, position 640 according to SEQ ID NO:46, position 581 according to SEQ ID NO:48, or position 662 according to SEQ ID NO:50; or position 648 according to SEQ ID NO:37, position 648 according to SEQ ID NO:39, position 648 according to SEQ ID NO:41, position 622 according to SEQ ID NO:43, position 641 according to SEQ ID NO:45, position 690 according to SEQ ID NO:47, position 631 according to SEQ ID NO:49, or position 712 according to SEQ ID NO:51; b) extending the primer at least through the position of the nucleotide sequence of the SOS2 cDNA molecule corresponding to: position 598 according to SEQ ID NO:36, position 598 according to SEQ ID NO:38, position 598 according to SEQ ID NO:40, position 572 according to SEQ ID NO:42, position 591 according to SEQ ID NO:44, position 640 according to SEQ ID NO:46, position 581 according to SEQ ID NO:48, or position 662 according to SEQ ID NO:50; or position 648 according to SEQ ID NO:37, position 648 according to SEQ ID NO:39, position 648 according to SEQ ID NO:41, position 622 according to SEQ ID NO:43, position 641 according to SEQ ID NO:45, position 690 according to SEQ ID NO:47, position 631 according to SEQ ID NO:49, or position 712 according to SEQ ID NO:51; and c) determining whether the extension product of the primer comprises: a guanine at a position corresponding to position 598 according to SEQ ID NO:36, a guanine at a position corresponding to position 598 according to SEQ ID NO:38, a guanine at a position corresponding to position 598 according to SEQ ID NO:40, a guanine at a position corresponding to position 572 according to SEQ ID NO:42, a guanine at a position corresponding to position 591 according to SEQ ID NO:44, a guanine at a position corresponding to position 640 according to SEQ ID NO:46, a guanine at a position corresponding to position 581 according to SEQ ID NO:48, or a guanine at a position corresponding to position 662 according to SEQ ID NO:50; or an adenine at a position corresponding to position 648 according to SEQ ID NO:37, an adenine at a position corresponding to position 648 according to SEQ ID NO:39, an adenine at a position corresponding to position 648 according to SEQ ID NO:41, an adenine at a position corresponding to position 622 according to SEQ ID NO:43, an adenine at a position corresponding to position 641 according to SEQ ID NO:45, an adenine at a position corresponding to position 690 according to SEQ ID NO:47, an adenine at a position corresponding to position 631 according to SEQ ID NO:49, or an adenine at a position corresponding to position 712 according to SEQ ID NO:51.

Embodiment 47. The method according to any one of embodiments 41 to 46, wherein the genotyping assay comprises sequencing the entire nucleic acid molecule.

Embodiment 48. The method according to any one of embodiments 35 to 40, wherein the genotyping assay comprises: a) amplifying at least a portion of the nucleic acid molecule that encodes the human SOS2 polypeptide, wherein the portion comprises: a guanine at a position corresponding to position 42,940 according to SEQ ID NO:2, or the complement thereof; or an adenine at a position corresponding to position 42,990 according to SEQ ID NO:3, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: a guanine at a position corresponding to position 42,940 according to SEQ ID NO:2, or the complement thereof; or an adenine at a position corresponding to position 42,990 according to SEQ ID NO:3, or the complement thereof; and d) detecting the detectable label.

Embodiment 49. The method according to any one of embodiments 35 to 40, wherein the genotyping assay comprises: a) amplifying at least a portion of the nucleic acid molecule that encodes the human SOS2 polypeptide, wherein the portion comprises: a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; and d) detecting the detectable label.

Embodiment 50. The method according to any one of embodiments 35 to 40, wherein the genotyping assay comprises: a) amplifying at least a portion of the nucleic acid molecule that encodes the human SOS2 polypeptide, wherein the portion comprises: a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50, or the complement thereof; or an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50, or the complement thereof; or an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof; and d) detecting the detectable label.

Embodiment 51. The method according to embodiment 50, wherein the nucleic acid molecule in the sample is mRNA and the mRNA is reverse-transcribed into cDNA prior to the amplifying step.

Embodiment 52. The method according to any one of embodiments 35 to 40, wherein the genotyping assay comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: a guanine at a position corresponding to position 42,940 according to SEQ ID NO:2, or the complement thereof; or an adenine at a position corresponding to position 42,990 according to SEQ ID NO:3, or the complement thereof; and detecting the detectable label.

Embodiment 53. The method according to any one of embodiments 35 to 40, wherein the genotyping assay comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; and detecting the detectable label.

Embodiment 54. The method according to any one of embodiments 35 to 40, wherein the genotyping assay comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50, or the complement thereof; or an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof; and detecting the detectable label.

Embodiment 55. The method according to any one of embodiments 35 to 54, wherein the nucleic acid molecule is present within a cell obtained from the human subject.

Embodiment 56. The method according to any one of embodiments 35 to 55, wherein the SOS2 inhibitor comprises an antisense nucleic acid molecule, a small interfering RNA (siRNA), or a short hairpin RNA (shRNA) that hybridizes to an SOS2 mRNA.

Embodiment 57. The method according to any one of embodiments 35 to 55, wherein the SOS2 inhibitor comprises a Cas protein and guide RNA (gRNA) that hybridizes to a gRNA recognition sequence within an SOS2 genomic nucleic acid molecule.

Embodiment 58. The method according to embodiment 57, wherein the Cas protein is Cas9 or Cpf1.

Embodiment 59. The method according to embodiment 57 or embodiment 58, wherein the gRNA recognition sequence includes or is proximate to a position corresponding to position 42,940 according to SEQ ID NO:1, or position 42,990 according to SEQ ID NO:1.

Embodiment 60. The method according to embodiment 57 or embodiment 58, wherein the gRNA recognition sequence is located from about 1000, from about 500, from about 400, from about 300, from about 200, from about 100, from about 50, from about 45, from about 40, from about 35, from about 30, from about 25, from about 20, from about 15, from about 10, or from about 5 nucleotides of a position corresponding to: position 42,940 according to SEQ ID NO:1 or position 42,990 according to SEQ ID NO:1.

Embodiment 61. The method according to embodiment 57 or embodiment 58, wherein a Protospacer Adjacent Motif (PAM) sequence is about 2 to 6 nucleotides downstream of the gRNA recognition sequence.

Embodiment 62. The method according to any one of embodiments 57 to 61, wherein the gRNA comprises from about 17 to about 23 nucleotides.

Embodiment 63. The method according to any one of embodiments 57 to 62, wherein the gRNA recognition sequence comprises a nucleotide sequence according to any one of SEQ ID NOS:61-71.

Embodiment 64. A method of identifying a human subject having an increased risk for developing an ophthalmic condition, wherein the method comprises: determining or having determined the presence or absence of an SOS2 predicted loss-of-function variant nucleic acid molecule encoding a human SOS2 polypeptide in a biological sample obtained from the subject; wherein: when the human subject is SOS2 reference, then the human subject has an increased risk for developing an ophthalmic condition; and when the human subject is heterozygous for an SOS2 predicted loss-of-function variant or homozygous for an SOS2 predicted loss-of-function variant, then the human subject has a decreased risk for developing an ophthalmic condition.

Embodiment 65. The method according to embodiment 64, wherein the SOS2 predicted loss-of-function variant nucleic acid molecule is a nucleic acid molecule encoding SOS2 Pro191Arg (Isoform 1), SOS2 Ala208Thr (Isoform 1), SOS2 Pro191Arg (Isoform 2), SOS2 Ala208Thr (Isoform 2), SOS2 Pro221Arg, or SOS2 Ala238Thr.

Embodiment 66. The method according to embodiment 64, wherein the SOS2 predicted loss-of-function variant nucleic acid molecule is a nucleic acid molecule encoding SOS2 Pro191Arg (Isoform 1) or SOS2 Ala208Thr (Isoform 1).

Embodiment 67. The method according to embodiment 65, wherein the SOS2 predicted loss-of-function variant nucleic acid molecule is: a genomic nucleic acid molecule having a nucleotide sequence comprising: a guanine at a position corresponding to position 42,940 according to SEQ ID NO:2, or an adenine at a position corresponding to position 42,990 according to SEQ ID NO:3; an mRNA molecule having a nucleotide sequence comprising: a guanine at a position corresponding to position 598 according to SEQ ID NO:12, a guanine at a position corresponding to position 598 according to SEQ ID NO:14, a guanine at a position corresponding to position 598 according to SEQ ID NO:16, a guanine at a position corresponding to position 572 according to SEQ ID NO:18, a guanine at a position corresponding to position 591 according to SEQ ID NO:20, a guanine at a position corresponding to position 640 according to SEQ ID NO:22, a guanine at a position corresponding to position 581 according to SEQ ID NO:24, or a guanine at a position corresponding to position 662 according to SEQ ID NO:26; or an adenine at a position corresponding to position 648 according to SEQ ID NO:13, an adenine at a position corresponding to position 648 according to SEQ ID NO:15, an adenine at a position corresponding to position 648 according to SEQ ID NO:17, an adenine at a position corresponding to position 622 according to SEQ ID NO:19, an adenine at a position corresponding to position 641 according to SEQ ID NO:21, an adenine at a position corresponding to position 690 according to SEQ ID NO:23, an adenine at a position corresponding to position 631 according to SEQ ID NO:25, or an adenine at a position corresponding to position 712 according to SEQ ID NO:27; or a cDNA molecule produced from an mRNA molecule, wherein the cDNA molecule has a nucleotide sequence comprising: a guanine at a position corresponding to position 598 according to SEQ ID NO:36, a guanine at a position corresponding to position 598 according to SEQ ID NO:38, a guanine at a position corresponding to position 598 according to SEQ ID NO:40, a guanine at a position corresponding to position 572 according to SEQ ID NO:42, a guanine at a position corresponding to position 591 according to SEQ ID NO:44, a guanine at a position corresponding to position 640 according to SEQ ID NO:46, a guanine at a position corresponding to position 581 according to SEQ ID NO:48, or a guanine at a position corresponding to position 662 according to SEQ ID NO:50; or an adenine at a position corresponding to position 648 according to SEQ ID NO:37, an adenine at a position corresponding to position 648 according to SEQ ID NO:39, an adenine at a position corresponding to position 648 according to SEQ ID NO:41, an adenine at a position corresponding to position 622 according to SEQ ID NO:43, an adenine at a position corresponding to position 641 according to SEQ ID NO:45, an adenine at a position corresponding to position 690 according to SEQ ID NO:47, an adenine at a position corresponding to position 631 according to SEQ ID NO:49, or an adenine at a position corresponding to position 712 according to SEQ ID NO:51.

Embodiment 68. The method according to any one of embodiments 64 to 67, wherein the determining step is carried out in vitro.

Embodiment 69. The method according to any one of embodiments 64 to 68, wherein the determining step comprises sequencing at least a portion of the nucleotide sequence of the SOS2 genomic nucleic acid molecule in the biological sample, wherein the sequenced portion comprises a position corresponding to: position 42,940 according to SEQ ID NO:2, or the complement thereof; or position 42,990 according to SEQ ID NO:3, or the complement thereof; wherein when the sequenced portion of the SOS2 genomic nucleic acid molecule in the biological sample comprises a guanine at a position corresponding to position 42,940 according to SEQ ID NO:2, or an adenine at a position corresponding to position 42,990 according to SEQ ID NO:3, then the SOS2 genomic nucleic acid molecule in the biological sample is an SOS2 predicted loss-of-function variant genomic nucleic acid molecule.

Embodiment 70. The method according to any one of embodiments 64 to 68, wherein the determining step comprises sequencing at least a portion of the nucleotide sequence of the SOS2 mRNA molecule in the biological sample, wherein the sequenced portion comprises a position corresponding to: position 598 according to SEQ ID NO:12, or the complement thereof; position 598 according to SEQ ID NO:14, or the complement thereof; position 598 according to SEQ ID NO:16, or the complement thereof; position 572 according to SEQ ID NO:18, or the complement thereof; position 591 according to SEQ ID NO:20, or the complement thereof; position 640 according to SEQ ID NO:22, or the complement thereof; position 581 according to SEQ ID NO:24, or the complement thereof; or position 662 according to SEQ ID NO:26, or the complement thereof; position 648 according to SEQ ID NO:13, or the complement thereof; position 648 according to SEQ ID NO:15, or the complement thereof; position 648 according to SEQ ID NO:17, or the complement thereof; position 622 according to SEQ ID NO:19, or the complement thereof; position 641 according to SEQ ID NO:21, or the complement thereof; position 690 according to SEQ ID NO:23, or the complement thereof; position 631 according to SEQ ID NO:25, or the complement thereof; or position 712 according to SEQ ID NO:27, or the complement thereof; wherein when the sequenced portion of the SOS2 mRNA molecule in the biological sample comprises: a guanine at a position corresponding to position 598 according to SEQ ID NO:12, a guanine at a position corresponding to position 598 according to SEQ ID NO:14, a guanine at a position corresponding to position 598 according to SEQ ID NO:16, a guanine at a position corresponding to position 572 according to SEQ ID NO:18, a guanine at a position corresponding to position 591 according to SEQ ID NO:20, a guanine at a position corresponding to position 640 according to SEQ ID NO:22, a guanine at a position corresponding to position 581 according to SEQ ID NO:24, or a guanine at a position corresponding to position 662 according to SEQ ID NO:26; or an adenine at a position corresponding to position 648 according to SEQ ID NO:13, an adenine at a position corresponding to position 648 according to SEQ ID NO:15, an adenine at a position corresponding to position 648 according to SEQ ID NO:17, an adenine at a position corresponding to position 622 according to SEQ ID NO:19, an adenine at a position corresponding to position 641 according to SEQ ID NO:21, an adenine at a position corresponding to position 690 according to SEQ ID NO:23, an adenine at a position corresponding to position 631 according to SEQ ID NO:25, or an adenine at a position corresponding to position 712 according to SEQ ID NO:27; then the SOS2 mRNA molecule in the biological sample is an SOS2 predicted loss-of-function variant mRNA molecule.

Embodiment 71. The method according to any one of embodiments 64 to 68, wherein the determining step comprises sequencing at least a portion of the nucleotide sequence of the SOS2 cDNA molecule in the biological sample, wherein the sequenced portion comprises a position corresponding to: position 598 according to SEQ ID NO:36, or the complement thereof; position 598 according to SEQ ID NO:38, or the complement thereof; position 598 according to SEQ ID NO:40, or the complement thereof; position 572 according to SEQ ID NO:42, or the complement thereof; position 591 according to SEQ ID NO:44, or the complement thereof; position 640 according to SEQ ID NO:46, or the complement thereof; position 581 according to SEQ ID NO:48, or the complement thereof; or position 662 according to SEQ ID NO:50, or the complement thereof; or position 648 according to SEQ ID NO:37, or the complement thereof; position 648 according to SEQ ID NO:39, or the complement thereof; position 648 according to SEQ ID NO:41, or the complement thereof; position 622 according to SEQ ID NO:43, or the complement thereof; position 641 according to SEQ ID NO:45, or the complement thereof; position 690 according to SEQ ID NO:47, or the complement thereof; position 631 according to SEQ ID NO:49, or the complement thereof; position 712 according to SEQ ID NO:51; wherein when the sequenced portion of the SOS2 cDNA molecule in the biological sample comprises: a guanine at a position corresponding to position 598 according to SEQ ID NO:36, a guanine at a position corresponding to position 598 according to SEQ ID NO:38, a guanine at a position corresponding to position 598 according to SEQ ID NO:40, a guanine at a position corresponding to position 572 according to SEQ ID NO:42, a guanine at a position corresponding to position 591 according to SEQ ID NO:44, a guanine at a position corresponding to position 640 according to SEQ ID NO:46, a guanine at a position corresponding to position 581 according to SEQ ID NO:48, or a guanine at a position corresponding to position 662 according to SEQ ID NO:50; or an adenine at a position corresponding to position 648 according to SEQ ID NO:37, an adenine at a position corresponding to position 648 according to SEQ ID NO:39, an adenine at a position corresponding to position 648 according to SEQ ID NO:41, an adenine at a position corresponding to position 622 according to SEQ ID NO:43, an adenine at a position corresponding to position 641 according to SEQ ID NO:45, an adenine at a position corresponding to position 690 according to SEQ ID NO:47, an adenine at a position corresponding to position 631 according to SEQ ID NO:49, or an adenine at a position corresponding to position 712 according to SEQ ID NO:51; then the SOS2 cDNA molecule in the biological sample is an SOS2 predicted loss-of-function variant cDNA molecule.

Embodiment 72. The method according to any one of embodiments 64 to 68, wherein the determining step comprises: a) contacting the biological sample with a primer hybridizing to a portion of the nucleotide sequence of the SOS2 genomic nucleic acid molecule that is proximate to a position corresponding to: position 42,940 according to SEQ ID NO:2, or position 42,990 according to SEQ ID NO:3; b) extending the primer at least through the position of the nucleotide sequence of the SOS2 genomic nucleic acid molecule corresponding to position 42,940 according to SEQ ID NO:2, or position 42,990 according to SEQ ID NO:3; and c) determining whether the extension product of the primer comprises a guanine at a position corresponding to position 42,940 according to SEQ ID NO:2, or an adenine at a position corresponding to position 42,990 according to SEQ ID NO:3.

Embodiment 73. The method according to any one of embodiments 64 to 68, wherein the determining step comprises: a) contacting the biological sample with a primer hybridizing to a portion of the nucleotide sequence of the SOS2 mRNA molecule that is proximate to a position corresponding to: position 598 according to SEQ ID NO:12, position 598 according to SEQ ID NO:14, position 598 according to SEQ ID NO:16, position 572 according to SEQ ID NO:18, position 591 according to SEQ ID NO:20, position 640 according to SEQ ID NO:22, position 581 according to SEQ ID NO:24, or position 662 according to SEQ ID NO:26; or position 648 according to SEQ ID NO:13, position 648 according to SEQ ID NO:15, position 648 according to SEQ ID NO:17, position 622 according to SEQ ID NO:19, position 641 according to SEQ ID NO:21, position 690 according to SEQ ID NO:23, position 631 according to SEQ ID NO:25, or position 712 according to SEQ ID NO:27; b) extending the primer at least through the position of the nucleotide sequence of the SOS2 mRNA molecule corresponding to: position 598 according to SEQ ID NO:12, position 598 according to SEQ ID NO:14, position 598 according to SEQ ID NO:16, position 572 according to SEQ ID NO:18, position 591 according to SEQ ID NO:20, position 640 according to SEQ ID NO:22, position 581 according to SEQ ID NO:24, or position 662 according to SEQ ID NO:26; or position 648 according to SEQ ID NO:13, position 648 according to SEQ ID NO:15, position 648 according to SEQ ID NO:17, position 622 according to SEQ ID NO:19, position 641 according to SEQ ID NO:21, position 690 according to SEQ ID NO:23, position 631 according to SEQ ID NO:25, or position 712 according to SEQ ID NO:27; and c) determining whether the extension product of the primer comprises: a guanine at a position corresponding to position 598 according to SEQ ID NO:12, a guanine at a position corresponding to position 598 according to SEQ ID NO:14, a guanine at a position corresponding to position 598 according to SEQ ID NO:16, a guanine at a position corresponding to position 572 according to SEQ ID NO:18, a guanine at a position corresponding to position 591 according to SEQ ID NO:20, a guanine at a position corresponding to position 640 according to SEQ ID NO:22, a guanine at a position corresponding to position 581 according to SEQ ID NO:24, or a guanine at a position corresponding to position 662 according to SEQ ID NO:26; or an adenine at a position corresponding to position 648 according to SEQ ID NO:13, an adenine at a position corresponding to position 648 according to SEQ ID NO:15, an adenine at a position corresponding to position 648 according to SEQ ID NO:17, an adenine at a position corresponding to position 622 according to SEQ ID NO:19, an adenine at a position corresponding to position 641 according to SEQ ID NO:21, an adenine at a position corresponding to position 690 according to SEQ ID NO:23, an adenine at a position corresponding to position 631 according to SEQ ID NO:25, or an adenine at a position corresponding to position 712 according to SEQ ID NO:27.

Embodiment 74. The method according to any one of embodiments 64 to 68, wherein the determining step comprises: a) contacting the biological sample with a primer hybridizing to a portion of the nucleotide sequence of the SOS2 cDNA molecule that is proximate to a position corresponding to: position 598 according to SEQ ID NO:36, position 598 according to SEQ ID NO:38, position 598 according to SEQ ID NO:40, position 572 according to SEQ ID NO:42, position 591 according to SEQ ID NO:44, position 640 according to SEQ ID NO:46, position 581 according to SEQ ID NO:48, or position 662 according to SEQ ID NO:50; or position 648 according to SEQ ID NO:37, position 648 according to SEQ ID NO:39, position 648 according to SEQ ID NO:41, position 622 according to SEQ ID NO:43, position 641 according to SEQ ID NO:45, position 690 according to SEQ ID NO:47, position 631 according to SEQ ID NO:49, or position 712 according to SEQ ID NO:51; b) extending the primer at least through the position of the nucleotide sequence of the SOS2 cDNA molecule corresponding to: position 598 according to SEQ ID NO:36, position 598 according to SEQ ID NO:38, position 598 according to SEQ ID NO:40, position 572 according to SEQ ID NO:42, position 591 according to SEQ ID NO:44, position 640 according to SEQ ID NO:46, position 581 according to SEQ ID NO:48, or position 662 according to SEQ ID NO:50; or position 648 according to SEQ ID NO:37, position 648 according to SEQ ID NO:39, position 648 according to SEQ ID NO:41, position 622 according to SEQ ID NO:43, position 641 according to SEQ ID NO:45, position 690 according to SEQ ID NO:47, position 631 according to SEQ ID NO:49, or position 712 according to SEQ ID NO:51; and c) determining whether the extension product of the primer comprises: a guanine at a position corresponding to position 598 according to SEQ ID NO:36, a guanine at a position corresponding to position 598 according to SEQ ID NO:38, a guanine at a position corresponding to position 598 according to SEQ ID NO:40, a guanine at a position corresponding to position 572 according to SEQ ID NO:42, a guanine at a position corresponding to position 591 according to SEQ ID NO:44, a guanine at a position corresponding to position 640 according to SEQ ID NO:46, a guanine at a position corresponding to position 581 according to SEQ ID NO:48, or a guanine at a position corresponding to position 662 according to SEQ ID NO:50; or an adenine at a position corresponding to position 648 according to SEQ ID NO:37, an adenine at a position corresponding to position 648 according to SEQ ID NO:39, an adenine at a position corresponding to position 648 according to SEQ ID NO:41, an adenine at a position corresponding to position 622 according to SEQ ID NO:43, an adenine at a position corresponding to position 641 according to SEQ ID NO:45, an adenine at a position corresponding to position 690 according to SEQ ID NO:47, an adenine at a position corresponding to position 631 according to SEQ ID NO:49, or an adenine at a position corresponding to position 712 according to SEQ ID NO:51.

Embodiment 75. The method according to any one of embodiments 69 to 74, wherein the determining step comprises sequencing the entire nucleic acid molecule.

Embodiment 76. The method according to any one of embodiments 64 to 68, wherein the determining step comprises: a) amplifying at least a portion of the nucleic acid molecule that encodes the human SOS2 polypeptide, wherein the portion comprises: a guanine at a position corresponding to position 42,940 according to SEQ ID NO:2, or the complement thereof; or an adenine at a position corresponding to position 42,990 according to SEQ ID NO:3, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: a guanine at a position corresponding to position 42,940 according to SEQ ID NO:2, or the complement thereof; or an adenine at a position corresponding to position 42,990 according to SEQ ID NO:3, or the complement thereof; and d) detecting the detectable label.

Embodiment 77. The method according to any one of embodiments 64 to 68, wherein the determining step comprises: a) amplifying at least a portion of the nucleic acid molecule that encodes the human SOS2 polypeptide, wherein the portion comprises: a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; and d) detecting the detectable label.

Embodiment 78. The method according to any one of embodiments 64 to 68, wherein the determining step comprises: a) amplifying at least a portion of the nucleic acid molecule that encodes the human SOS2 polypeptide, wherein the portion comprises: a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50, or the complement thereof; or an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50, or the complement thereof; or an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof; and d) detecting the detectable label.

Embodiment 79. The method according to embodiment 78, wherein the nucleic acid molecule in the sample is mRNA and the mRNA is reverse-transcribed into cDNA prior to the amplifying step.

Embodiment 80. The method according to any one of embodiments 64 to 68, wherein the detecting step comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: a guanine at a position corresponding to position 42,940 according to SEQ ID NO:2, or the complement thereof; or an adenine at a position corresponding to position 42,990 according to SEQ ID NO:3, or the complement thereof; and detecting the detectable label.

Embodiment 81. The method according to any one of embodiments 64 to 68, wherein the detecting step comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; and detecting the detectable label.

Embodiment 82. The method according to any one of embodiments 64 to 68, wherein the detecting step comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50, or the complement thereof; or an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof; and detecting the detectable label.

Embodiment 83. The method according to any one of embodiments 64 to 82, wherein the human subject is SOS2 reference, and the human subject is administered a therapeutic agent that treats or inhibits an ophthalmic condition in a standard dosage amount, and is administered an SOS2 inhibitor.

Embodiment 84. The method according to any one of embodiments 64 to 82, wherein the human subject is heterozygous for an SOS2 predicted loss-of-function variant, and the human subject is administered a therapeutic agent that treats or inhibits an ophthalmic condition in an amount that is the same as or lower than a standard dosage amount, and is administered an SOS2 inhibitor.

Embodiment 85. A method of detecting a human SOS2 variant nucleic acid molecule in a human subject comprising assaying a sample obtained from the human subject to determine whether a nucleic acid molecule in the sample is: a genomic nucleic acid molecule having a nucleotide sequence comprising: a guanine at a position corresponding to position 42,940 according to SEQ ID NO:2, or the complement thereof; or an adenine at a position corresponding to position 42,990 according to SEQ ID NO:3, or the complement thereof; an mRNA molecule having a nucleotide sequence comprising: a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; or a cDNA molecule produced from an mRNA molecule, wherein the cDNA molecule has a nucleotide sequence comprising: a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50; or an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof.

Embodiment 86. The method according to embodiment 85, wherein the method is an in vitro method.

Embodiment 87. The method according to embodiment 85 or embodiment 86, wherein the assay comprises sequencing at least a portion of the nucleic acid molecule, wherein the sequenced portion comprises: a guanine at a position corresponding to position 42,940 according to SEQ ID NO:2, or the complement thereof; or an adenine at a position corresponding to position 42,990 according to SEQ ID NO:3, or the complement thereof.

Embodiment 88. The method according to embodiment 85 or embodiment 86, wherein the assay comprises sequencing at least a portion of the nucleic acid molecule, wherein the sequenced portion comprises: a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof.

Embodiment 89. The method according to embodiment 85 or embodiment 86, wherein the assay comprises sequencing at least a portion of the nucleic acid molecule, wherein the sequenced portion comprises: a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50; or an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof.

Embodiment 90. The method according to embodiment 85 or embodiment 86, wherein the assay comprises: a) contacting the sample with a primer hybridizing to a portion of the nucleotide sequence of the SOS2 genomic nucleic acid molecule that is proximate to a position corresponding to: position 42,940 according to SEQ ID NO:2, or position 42,990 according to SEQ ID NO:3; b) extending the primer at least through the position of the nucleotide sequence of the SOS2 genomic nucleic acid molecule corresponding to position 42,940 according to SEQ ID NO:2, or position 42,990 according to SEQ ID NO:3; and c) determining whether the extension product of the primer comprises a guanine at a position corresponding to position 42,940 according to SEQ ID NO:2, or an adenine at a position corresponding to position 42,990 according to SEQ ID NO:3.

Embodiment 91. The method according to embodiment 85 or embodiment 86, wherein the assay comprises: a) contacting the sample with a primer hybridizing to a portion of the nucleotide sequence of the SOS2 mRNA molecule that is proximate to a position corresponding to: position 598 according to SEQ ID NO:12, position 598 according to SEQ ID NO:14, position 598 according to SEQ ID NO:16, position 572 according to SEQ ID NO:18, position 591 according to SEQ ID NO:20, position 640 according to SEQ ID NO:22, position 581 according to SEQ ID NO:24, or position 662 according to SEQ ID NO:26; or position 648 according to SEQ ID NO:13, position 648 according to SEQ ID NO:15, position 648 according to SEQ ID NO:17, position 622 according to SEQ ID NO:19, position 641 according to SEQ ID NO:21, position 690 according to SEQ ID NO:23, position 631 according to SEQ ID NO:25, or position 712 according to SEQ ID NO:27; b) extending the primer at least through the position of the nucleotide sequence of the SOS2 mRNA molecule corresponding to: position 598 according to SEQ ID NO:12, position 598 according to SEQ ID NO:14, position 598 according to SEQ ID NO:16, position 572 according to SEQ ID NO:18, position 591 according to SEQ ID NO:20, position 640 according to SEQ ID NO:22, position 581 according to SEQ ID NO:24, or position 662 according to SEQ ID NO:26; or position 648 according to SEQ ID NO:13, position 648 according to SEQ ID NO:15, position 648 according to SEQ ID NO:17, position 622 according to SEQ ID NO:19, position 641 according to SEQ ID NO:21, position 690 according to SEQ ID NO:23, position 631 according to SEQ ID NO:25, or position 712 according to SEQ ID NO:27; and c) determining whether the extension product of the primer comprises: a guanine at a position corresponding to position 598 according to SEQ ID NO:12, a guanine at a position corresponding to position 598 according to SEQ ID NO:14, a guanine at a position corresponding to position 598 according to SEQ ID NO:16, a guanine at a position corresponding to position 572 according to SEQ ID NO:18, a guanine at a position corresponding to position 591 according to SEQ ID NO:20, a guanine at a position corresponding to position 640 according to SEQ ID NO:22, a guanine at a position corresponding to position 581 according to SEQ ID NO:24, or a guanine at a position corresponding to position 662 according to SEQ ID NO:26; or an adenine at a position corresponding to position 648 according to SEQ ID NO:13, an adenine at a position corresponding to position 648 according to SEQ ID NO:15, an adenine at a position corresponding to position 648 according to SEQ ID NO:17, an adenine at a position corresponding to position 622 according to SEQ ID NO:19, an adenine at a position corresponding to position 641 according to SEQ ID NO:21, an adenine at a position corresponding to position 690 according to SEQ ID NO:23, an adenine at a position corresponding to position 631 according to SEQ ID NO:25, or an adenine at a position corresponding to position 712 according to SEQ ID NO:27.

Embodiment 92. The method according to embodiment 85 or embodiment 86, wherein the assay comprises: a) contacting the sample with a primer hybridizing to a portion of the nucleotide sequence of the SOS2 cDNA molecule that is proximate to a position corresponding to: position 598 according to SEQ ID NO:36, position 598 according to SEQ ID NO:38, position 598 according to SEQ ID NO:40, position 572 according to SEQ ID NO:42, position 591 according to SEQ ID NO:44, position 640 according to SEQ ID NO:46, position 581 according to SEQ ID NO:48, or position 662 according to SEQ ID NO:50; or position 648 according to SEQ ID NO:37, position 648 according to SEQ ID NO:39, position 648 according to SEQ ID NO:41, position 622 according to SEQ ID NO:43, position 641 according to SEQ ID NO:45, position 690 according to SEQ ID NO:47, position 631 according to SEQ ID NO:49, or position 712 according to SEQ ID NO:51; b) extending the primer at least through the position of the nucleotide sequence of the SOS2 cDNA molecule corresponding to: position 598 according to SEQ ID NO:36, position 598 according to SEQ ID NO:38, position 598 according to SEQ ID NO:40, position 572 according to SEQ ID NO:42, position 591 according to SEQ ID NO:44, position 640 according to SEQ ID NO:46, position 581 according to SEQ ID NO:48, or position 662 according to SEQ ID NO:50; or position 648 according to SEQ ID NO:37, position 648 according to SEQ ID NO:39, position 648 according to SEQ ID NO:41, position 622 according to SEQ ID NO:43, position 641 according to SEQ ID NO:45, position 690 according to SEQ ID NO:47, position 631 according to SEQ ID NO:49, or position 712 according to SEQ ID NO:51; and c) determining whether the extension product of the primer comprises: a guanine at a position corresponding to position 598 according to SEQ ID NO:36, a guanine at a position corresponding to position 598 according to SEQ ID NO:38, a guanine at a position corresponding to position 598 according to SEQ ID NO:40, a guanine at a position corresponding to position 572 according to SEQ ID NO:42, a guanine at a position corresponding to position 591 according to SEQ ID NO:44, a guanine at a position corresponding to position 640 according to SEQ ID NO:46, a guanine at a position corresponding to position 581 according to SEQ ID NO:48, or a guanine at a position corresponding to position 662 according to SEQ ID NO:50; or an adenine at a position corresponding to position 648 according to SEQ ID NO:37, an adenine at a position corresponding to position 648 according to SEQ ID NO:39, an adenine at a position corresponding to position 648 according to SEQ ID NO:41, an adenine at a position corresponding to position 622 according to SEQ ID NO:43, an adenine at a position corresponding to position 641 according to SEQ ID NO:45, an adenine at a position corresponding to position 690 according to SEQ ID NO:47, an adenine at a position corresponding to position 631 according to SEQ ID NO:49, or an adenine at a position corresponding to position 712 according to SEQ ID NO:51.

Embodiment 93. The method according to any one of embodiments 87 to 92, wherein the assay comprises sequencing the entire nucleic acid molecule.

Embodiment 94. The method according to embodiment 85 or embodiment 86, wherein the assay comprises: a) amplifying at least a portion of the nucleic acid molecule that encodes the human SOS2 polypeptide, wherein the portion comprises: a guanine at a position corresponding to position 42,940 according to SEQ ID NO:2, or the complement thereof; or an adenine at a position corresponding to position 42,990 according to SEQ ID NO:3, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: a guanine at a position corresponding to position 42,940 according to SEQ ID NO:2, or the complement thereof; or an adenine at a position corresponding to position 42,990 according to SEQ ID NO:3, or the complement thereof; and d) detecting the detectable label.

Embodiment 95. The method according to embodiment 85 or embodiment 86, wherein the assay comprises: a) amplifying at least a portion of the nucleic acid molecule that encodes the human SOS2 polypeptide, wherein the portion comprises: a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; and d) detecting the detectable label.

Embodiment 96. The method according to embodiment 85 or embodiment 86, wherein the assay comprises: a) amplifying at least a portion of the nucleic acid molecule that encodes the human SOS2 polypeptide, wherein the portion comprises: a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50, or the complement thereof; or an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50, or the complement thereof; or an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof; and d) detecting the detectable label.

Embodiment 97. The method according to embodiment 96, wherein the nucleic acid molecule in the sample is mRNA and the mRNA is reverse-transcribed into cDNA prior to the amplifying step.

Embodiment 98. The method according to embodiment 85 or embodiment 86, wherein the assay comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: a guanine at a position corresponding to position 42,940 according to SEQ ID NO:2, or the complement thereof; or an adenine at a position corresponding to position 42,990 according to SEQ ID NO:3, or the complement thereof; and detecting the detectable label.

Embodiment 99. The method according to embodiment 85 or embodiment 86, wherein the assay comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; and detecting the detectable label.

Embodiment 100. The method according to embodiment 85 or embodiment 86, wherein the assay comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50, or the complement thereof; or an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof; and detecting the detectable label.

Embodiment 101. The method according to any one of embodiments 85 to 100, wherein the nucleic acid molecule is present within a cell obtained from the human subject.

Embodiment 102. A method of detecting the presence of a human SOS2 Pro191Arg (Isoform 1), Ala208Thr (Isoform 1), Pro191Arg (Isoform 2), Ala208Thr (Isoform 2), Pro221Arg, or Ala238Thr variant polypeptide, comprising performing an assay on a sample obtained from a human subject to determine whether an SOS2 protein in the sample comprises: an arginine at a position corresponding to position 191 according to SEQ ID NO:55; a threonine at a position corresponding to position 208 according to SEQ ID NO:56; an arginine at a position corresponding to position 191 according to SEQ ID NO:57; a threonine at a position corresponding to position 208 according to SEQ ID NO:58; an arginine at a position corresponding to position 221 according to SEQ ID NO:59; or a threonine at a position corresponding to position 238 according to SEQ ID NO:60.

Embodiment 103. The method according to embodiment 102, wherein the assay comprises sequencing the polypeptide.

Embodiment 104. The method according to embodiment 102, wherein the assay is an immunoassay.

Embodiment 105. A therapeutic agent that treats or inhibits an ophthalmic condition for use in the treatment of an ophthalmic condition in a human subject having: i) a genomic nucleic acid molecule having a nucleotide sequence encoding a human SOS2 polypeptide, wherein the nucleotide sequence comprises: a guanine at a position corresponding to position 42,940 according to SEQ ID NO:2, or the complement thereof; or an adenine at a position corresponding to position 42,990 according to SEQ ID NO:3, or the complement thereof; ii) an mRNA molecule having a nucleotide sequence encoding a human SOS2 polypeptide, wherein the nucleotide sequence comprises: a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; or iii) a cDNA molecule having a nucleotide sequence encoding a human SOS2 polypeptide, wherein the nucleotide sequence comprises: a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50; or an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof.

Embodiment 106. An SOS2 inhibitor for use in the treatment of an ophthalmic condition in a human subject having: i) a genomic nucleic acid molecule having a nucleotide sequence encoding a human SOS2 polypeptide, wherein the nucleotide sequence comprises: a guanine at a position corresponding to position 42,940 according to SEQ ID NO:2, or the complement thereof; or an adenine at a position corresponding to position 42,990 according to SEQ ID NO:3, or the complement thereof; ii) an mRNA molecule having a nucleotide sequence encoding a human SOS2 polypeptide, wherein the nucleotide sequence comprises: a guanine at a position corresponding to position 598 according to SEQ ID NO:12, or the complement thereof; a guanine at a position corresponding to position 598 according to SEQ ID NO:14, or the complement thereof; a guanine at a position corresponding to position 598 according to SEQ ID NO:16, or the complement thereof; a guanine at a position corresponding to position 572 according to SEQ ID NO:18, or the complement thereof; a guanine at a position corresponding to position 591 according to SEQ ID NO:20, or the complement thereof; a guanine at a position corresponding to position 640 according to SEQ ID NO:22, or the complement thereof; a guanine at a position corresponding to position 581 according to SEQ ID NO:24, or the complement thereof; or a guanine at a position corresponding to position 662 according to SEQ ID NO:26, or the complement thereof; or an adenine at a position corresponding to position 648 according to SEQ ID NO:13, or the complement thereof; an adenine at a position corresponding to position 648 according to SEQ ID NO:15, or the complement thereof; an adenine at a position corresponding to position 648 according to SEQ ID NO:17, or the complement thereof; an adenine at a position corresponding to position 622 according to SEQ ID NO:19, or the complement thereof; an adenine at a position corresponding to position 641 according to SEQ ID NO:21, or the complement thereof; an adenine at a position corresponding to position 690 according to SEQ ID NO:23, or the complement thereof; an adenine at a position corresponding to position 631 according to SEQ ID NO:25, or the complement thereof; or an adenine at a position corresponding to position 712 according to SEQ ID NO:27, or the complement thereof; or iii) a cDNA molecule having a nucleotide sequence encoding a human SOS2 polypeptide, wherein the nucleotide sequence comprises: a guanine at a position corresponding to position 598 according to SEQ ID NO:36, or the complement thereof; a guanine at a position corresponding to position 598 according to SEQ ID NO:38, or the complement thereof; a guanine at a position corresponding to position 598 according to SEQ ID NO:40, or the complement thereof; a guanine at a position corresponding to position 572 according to SEQ ID NO:42, or the complement thereof; a guanine at a position corresponding to position 591 according to SEQ ID NO:44, or the complement thereof; a guanine at a position corresponding to position 640 according to SEQ ID NO:46, or the complement thereof; a guanine at a position corresponding to position 581 according to SEQ ID NO:48, or the complement thereof; or a guanine at a position corresponding to position 662 according to SEQ ID NO:50; or an adenine at a position corresponding to position 648 according to SEQ ID NO:37, or the complement thereof; an adenine at a position corresponding to position 648 according to SEQ ID NO:39, or the complement thereof; an adenine at a position corresponding to position 648 according to SEQ ID NO:41, or the complement thereof; an adenine at a position corresponding to position 622 according to SEQ ID NO:43, or the complement thereof; an adenine at a position corresponding to position 641 according to SEQ ID NO:45, or the complement thereof; an adenine at a position corresponding to position 690 according to SEQ ID NO:47, or the complement thereof; an adenine at a position corresponding to position 631 according to SEQ ID NO:49, or the complement thereof; or an adenine at a position corresponding to position 712 according to SEQ ID NO:51, or the complement thereof.

Embodiment 107. The SOS2 inhibitor according to embodiment 106, which is an antisense nucleic acid molecule, a small interfering RNA (siRNA), or a short hairpin RNA (shRNA) that hybridizes to an SOS2 mRNA.

Embodiment 108. The SOS2 inhibitor according to embodiment 106, which comprises a Cas protein and guide RNA (gRNA) that hybridizes to a gRNA recognition sequence within an SOS2 genomic nucleic acid molecule.

Embodiment 109. The SOS2 inhibitor according to embodiment 106, wherein the Cas protein is Cas9 or Cpf1.

Embodiment 110. The SOS2 inhibitor according to embodiment 108 or embodiment 109, wherein the gRNA recognition sequence includes or is proximate to position 42,940 according to SEQ ID NO:1, or position 42,990 according to SEQ ID NO:1.

Embodiment 111. The SOS2 inhibitor according to embodiment 108 or embodiment 109, wherein the gRNA recognition sequence is located from about 1000, from about 500, from about 400, from about 300, from about 200, from about 100, from about 50, from about 45, from about 40, from about 35, from about 30, from about 25, from about 20, from about 15, from about 10, or from about 5 nucleotides of a position corresponding to position 42,940 according to SEQ ID NO:1, or position 42,990 according to SEQ ID NO:1.

Embodiment 112. The SOS2 inhibitor according to embodiment 108 or embodiment 109, wherein a Protospacer Adjacent Motif (PAM) sequence is about 2 to about 6 nucleotides downstream of the gRNA recognition sequence.

Embodiment 113. The SOS2 inhibitor according to any one of embodiments 108 to 112, wherein the gRNA comprises from about 17 to about 23 nucleotides.

Embodiment 114. The SOS2 inhibitor according to any one of embodiments 108 to 112, wherein the gRNA recognition sequence comprises a nucleotide sequence according to any one of SEQ ID NOS:61-71.

The following examples are provided to describe the embodiments in greater detail. They are intended to illustrate, not to limit, the claimed embodiments. The following examples provide those of ordinary skill in the art with a disclosure and description of how the compounds, compositions, articles, devices and/or methods described herein are made and evaluated, and are intended to be purely exemplary and are not intended to limit the scope of any claims. Efforts have been made to ensure accuracy with respect to numbers (such as, for example, amounts, temperature, etc.), but some errors and deviations may be accounted for. Unless indicated otherwise, parts are parts by weight, temperature is in ° C. or is at ambient temperature, and pressure is at or near atmospheric.

EXAMPLES

Example 1: Exome Sequencing Analysis

Figure 1B:
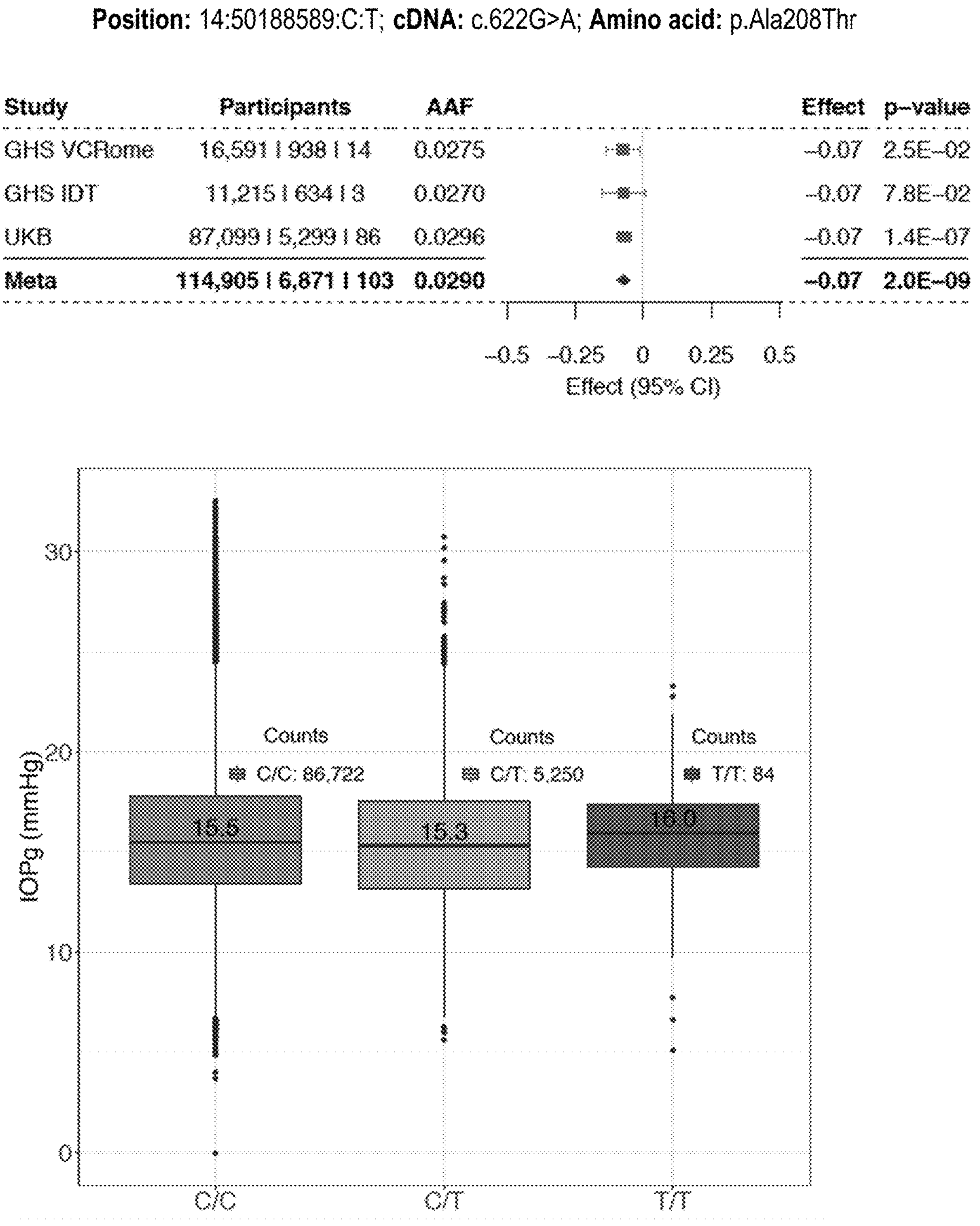
Figure 2A:
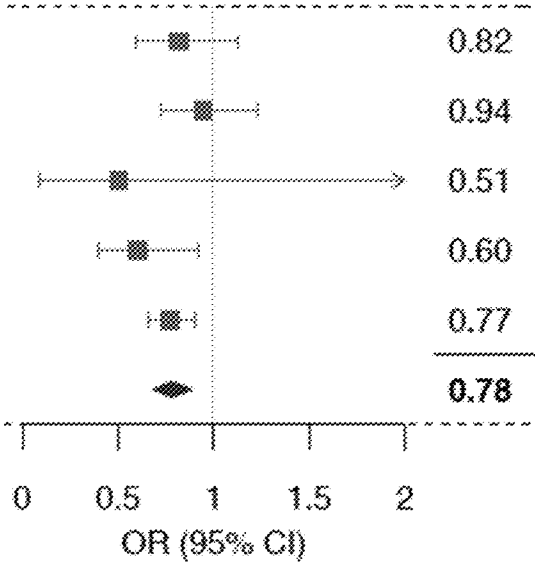
FIGS. 2A and 2B show data demonstrating that two missense variants in SOS2 are associated with reduced risk for glaucoma (FIG. 2A=Pro191Arg.
Figure 2B:
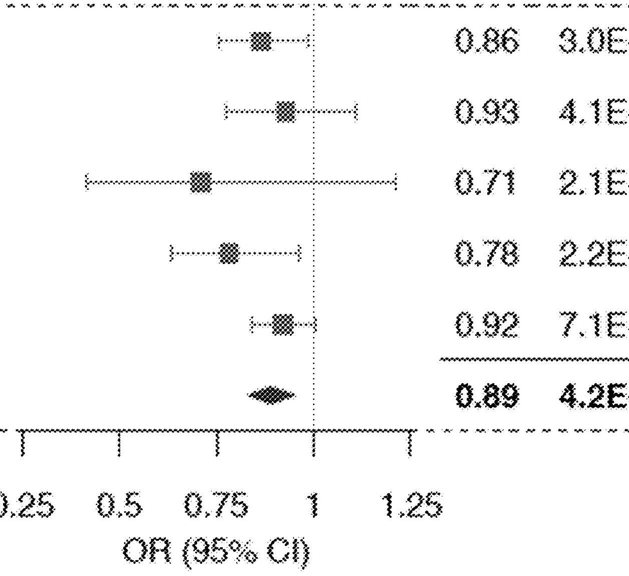
Figure 3:
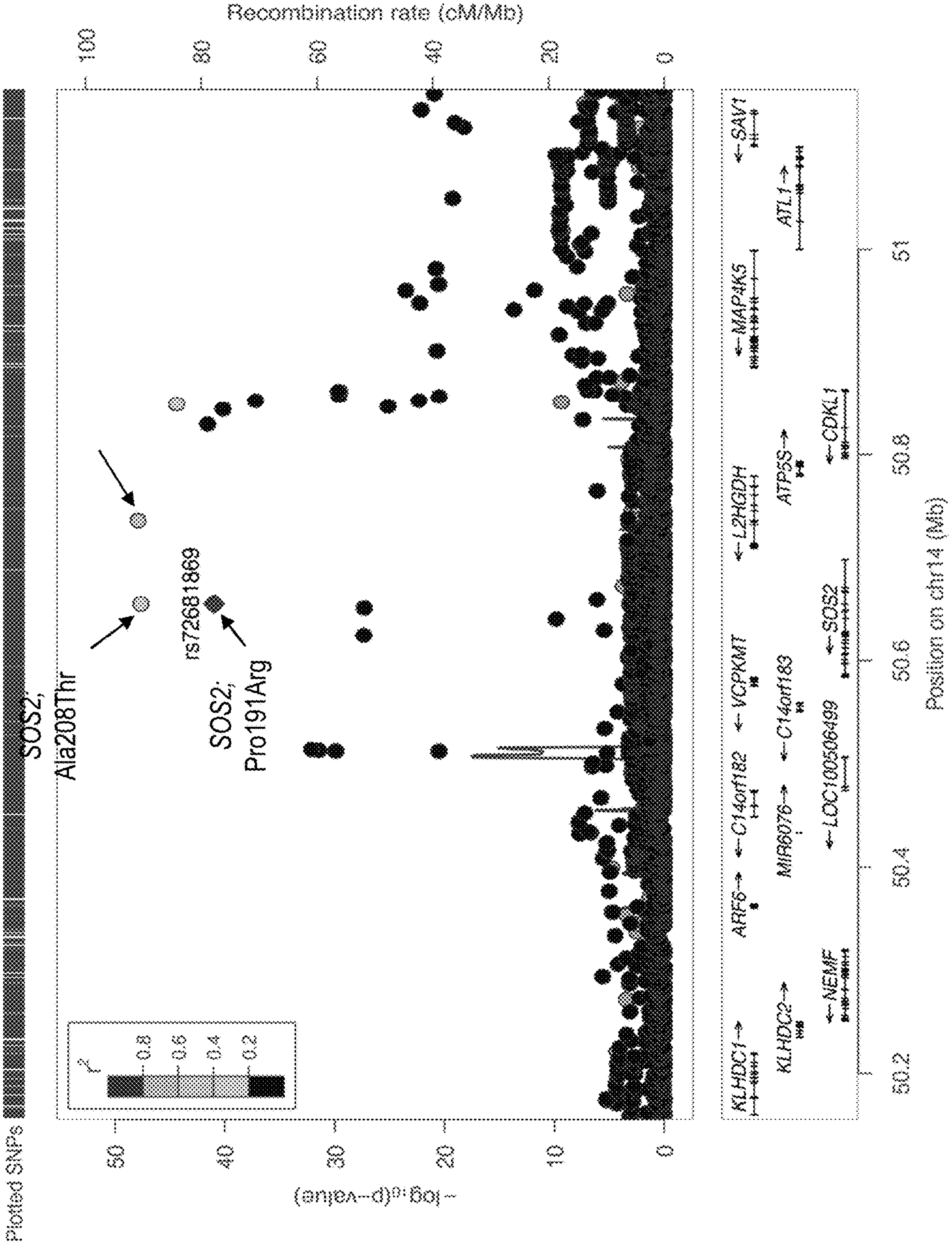
FIG. 3 shows data demonstrating that two missense variants in SOS2 are associated with aspartate aminotransferase (AST).

Exome sequencing and analysis in conjunction with the UK Biobank (UKB) and Geisinger freeze145k exome dataset identified that two missense variants (Pro191Arg and Ala208Thr) associates with decreased IOP (FIGS. 1A and 1B), glaucoma (FIGS. 2A and 2B), and AST (FIG. 3). The meta-analysis identified a rare, missense variant in SOS2 (Pro191Arg, MAF: ~1%) associated with reduced IOP (Beta=−0.11, p-value=3.4E−08). An additional, common missense variant in SOS2 (Ala208Thr, MAF: ~3%) was also associated with reduced IOP (Beta=−0.07, p-value=2.0E−09). Both variants were associated with a reduced risk for glaucoma (Pro191Arg: OR=0.78, p-value=1.4E−04; Ala208Thr: OR=0.89, p-value=4.2E−04)

Various modifications of the described subject matter, in addition to those described herein, will be apparent to those skilled in the art from the foregoing description. Such modifications are also intended to fall within the scope of the appended claims. Each reference (including, but not limited to, journal articles, U.S. and non-U.S. patents, patent application publications, international patent application publications, gene bank accession numbers, and the like) cited in the present application is incorporated herein by reference in its entirety and for all purposes.

SEQUENCE LISTING (71 sequences)

SEQ ID NO: 1 - DNA, 114449 bp, Homo sapiens
  source 1..114449: mol_type = genomic DNA
agaagcgggccagcgccgccgggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggtcagtgctaggggcggggcggccggcgggtggcccgtggccccccgagcttctaacggggagcaggtcgtccctcccacagggctcgagtccccggggccgagccgtttctcgttggctggcaatggggggctcacaattgcctgttgcattctgaaggacgtttctcaagttttttttttttgcctggtcccggaaggaaggttttgttatgatcataaaactggatttcatgttgcagtcatttcgtcaggcaacttccgccgttgaccaatttgttgtcctcaggctggaatcgggcaagagaaagtcccgctggtatttagacagtttctaaaacaaaagcacattttcaggccgggtaattacttttaattaagttctttgggagtgttccccctaggcggtttgcttgtcaagggtatccacttatgaggcaatggttttttgtaatatggatgtttcacatgtgtgaaatgtcagtgagtcataatattcttattcattttacagttctcaaggtaaatttaaagcgccttcccacttcctgcaaacggtgtcttacctgtttacaagagattacccttagaaaatttggtcagtgtcttcagtgtcttcacgaccaaattgcgatttaggacttgaaatcattttaaggaacaagaaaggggcaactcctgcaaatcagtctttcatgtttgggtgcattgctagggtgcatctttcctgtagatggtggcggtcttcctctgtgaatttaggtagtaaccatacgatcatttttataataaatccttctgtaagatcaagacatttaaagactgtgaataggtgcgtgatcagctgtcatgcctgttgagcaggggctttctttctttgccgttaatgcagacttagtctcttctgccttttgtgcaaaataaccaagaatacattctaaaataaggaaaaaataaagattaatttaaaagactatacttggaaaatatatcctcagacattaaatttctataaatgaaaggaagtagtgtattttaaagttaaagacattttcctcatgcgatgagagttgcagattttcccttattttcataattcttacaaggaagtattgctttcctcagggcaaacactaagtcgtatctttttaaagaacctggcagaaatgactagtggcagctagacagttattccattggtataccaagtgctaaagtattaaattgaccttacttccatgtgcagcccaattctgtaaggagagggaaagaaatgaaaagtgtgctgagtggtgaaaatgaactctggcctgaattaaaagcaaagggggaaatgcctagatagtaattagccctttgaccacagacaagtgtgagtgcagtaatcaggtaggcctatattgttggcaatgtgacgcaggtatatacccatttataactttctggtagcaaatagtatttgggtgtgtgttgcataacttgttcaataggtagctttgattctaataatcctttatgtccagaaacagatttatgttttctttttcttcaaatagagacagggttatgctatgttgcccaggctggtcttgaacttctggcctcaagcagtccgcccacctctgccttccaaactgttgggattacaggcataaaccacctcgcaccagacccagatttttttttttttttttcaagttaggctggagaagccaagattagcatccaatcctagtccattgctttggtgctattactttgcatttatattgtgcttgttttcctggaactcaggtgccttgtagatactatgttatattccacagttctagtatgttctttatgaaataaatacatctaagaaaatttggtcttttgaggtgaattcagaaaacattttctattaacttactgttgtgatagaattgaaatacatacgtatggaaaatttttttatatttttggaaaaattttggtaaaagtaattaagattatgtccacttttatggtatttaggacattgcaacttgtaggtctgtagtgcctgctaagagctgtagctcttagggagctaaaggttcactctttctttgcaggaagttttaaattctggtatgcatcagccaccttgtctttgtaaaatgagaatttctaccattttgggggagtctctgtcttcacattcagagcatctagaacttggcatccttcctctagctgaccagatcgttacaaagacaactaggatttgattggaatatctctctccttcaattggtgttgccattgtacatgtggtgtattctagcttcattaattcacttaaccattattgaacacattttacatacttgacatgatgcgggatcctaagagtacaaagttaaaataaaggcccctccaaagatgtataccatctaaaccaaaaattctaaaatttgaggttttggtttatgtaaatgagagcggttctgagctcagagttcagtaaggggtatttgtgtgtctatgaaagcagcaatgtagcttacttggctctgtcagtttagtccacttggacatcttggtggaacctccaaaactgttagaacgtaattttcagaaaggtaaagtcatcacttccatgcaaatgtaaatgaacatgtatcaattattttgattcagcccattgatgagggaactagtaagatgttaaagtcacttaatatgaaaatttgaggaggtatttataggcaatttaataagggaatattaagactgttgggttacatacagaattagttaataccctacaagaaacataaaagagtaggctttgggttatattttcctctggctaaaaattacttgcatctcagtgggcgtggtggctcacacctgtaatccagcactctgggaggctgaggctggtggatcaactgagtttaggagttcgtgaccagcctggccagcatggtgaaaccccgtctctactaaaaaataccaaaaattagctgggtgtggtggtgtgtgcctgtaatcccagctgctcaggaggctgaggcaggagaatcacttgaacctgctaggcagaggttgcagtgagccgagatcacaccactgcactccatcctgggcgacagagcgagactccatctcaaaaaaaaaaaaaaaattacttgcatctctatctgctgaaaagctgtaacttaatcttatagatgtgtaaaatagtcagtagaaattaataaaagattcaagcatagcactgtactgaaacacagccagtattcttttgcttattttccagttttggctagtttttatgaaaactggatatctatgtctatatccatgtatatatccatatatacccatatatagatccatatatatatgtatttgacaaagtcaccattgtcaacattgaaaattcaagggatttttaaaaaaccaatctcaagtattcattgcattacatagaaacacagagatgggctgggcgcagtggctcatgcctgtaatcccatttgggaggccaaggcgggcagattacctgaggtcaggagatcgagaccatgctggctaacacggtgaaaccccatctctactaaaaatacagaaaaaaacccaaaaaattagccgggcgtggtggcggacgcctgtagtcccagctactcgggaggctgaggcaggagaatggtatgaacccagaaggtggagcttgcagttgagccgagatcgcgccactgcactccagcatgggcgatggagtaagactctgtctcaaaaaaaaaaaataccaaaattagccaagtgtggtggtgcatgcctgtgatcccagctactcgggaggctgaggcagagaatctcttgaacatgggaggcagaggttagagtgggctgagatcgcaccactgcactccagcctgggcgacagagcgagactctgtctcaaaaaaaaaaaaaaagaaagaaagaaagaaaaagaaacacagagatagacaaataggtttatggaaaaataattttgggaatagaaatgtggtgttctttagctttttgcttgttcttaaacttttaaaatagaacctcacctagatcatttaaaaacagagagctacaaagcagagtgaaatgacactactaatggataatgcatggattgttaacattactgctaaattatgtatcttccctaaaagagcctagaacataattgccttcaccactgctccccaagatcattgaagctattgtgttacttggggaaaaaagagcatggtgtatatttgtaaatgcagtttattacctgtgtcgttgaaatcccttggtactatatgcatgtgttatttgattatatgttgagataaatcagcattcttcatatgggaaatatgcctcaaaatcattttatcagattttacagtccctgatatttattttgtagatgtcttttctgtaaggtgtttttcaccaggctagccatagaaaagaacatggctgttttcttgccagctgtagttaaaaatgtcagagaaagctagaaagaattggttgaattactttgttcctgagtccaattagattcaggttaaatatcgacctccccaccctgtgacaatttgctcttagatatctaaaaggcaagaggtgtgagagaatgtctgggttaattaatagcagtctacggcaaggaaaaagatcggtaggggctttgatttaaaaatggttttgtgaagttctactgagatcctagtgtttctgcgtttgtacaaatgtctcttggaagtttgttttagaagatggcactggatctttcctgaggcccacaagaaaagtacagggtgatctgagaaaatataactggtgtcattgatatatgagagtcaaagaagactttaagcaagcaacatttgtgcttctttctggattatatattcaaatatagtaatattactgtctccaggctggtcttgaactcctgggctcaagcgatcctcccaccttggcctccaaaaatgctgggattacaggtgtaagctacgtcgcctggctgcagacactgttcttgatacggaagatgtagcagagcccctgctgttataaagcttgtgttctaagtggctgtggcagagagacagacaataaggaagtaaacaattatctgaaagatcagtagaattaacaagaaaaaaaaagggcgggggggaaggatttgaggctgaggggaaagtaagaacatgatttgtttgtttgtttgttttgaataggtctcagattctgaatttaatgacttattttaaaaaacaagaagaataagtggatgaagctagtatggtagactgtaggtacactgagttaaggtctctgcctgagaataggaagtcctgttgggttctcatttacatagcaaagtaattagattaacttgatcagaattgctttttgaaaagattacttcaagtcaaagccaaaaactaataagagatcctgtgatttttgtgacatgagcctgttctggaattcctaaagccgctgaatgtaacagtagaactcgagggagtcatttggaattattccaaactaataatgacccaaactgacccgaagagttcagccagaactagatgagcggtaggaatgtactttaacttgctgtacttggctccctgtcagcaatgattaagtagccttctatttttggtttaattttggtatggtatatttggagcaataatattccattaaagtgttttatgctgagtattcaaagcattacctgtgttaccccttgacataaatcaactatatgtcttttgtattaaccatggactctctttcaagggaacagtaatttgattatatcctgcatatttgaatcaaaaggaattttaatgtaactagtggatttagcattatctcatgttaaaaattaacaaccaaaaattattttcttccatgggccaggtgcagtagctcatgcctgtaatcctagtactttgggaggctgagatgggaggattgcttgaggccaggagttcaagaccaacctggccaacatagcgagaccccatgtccataaaaaattattttcttcttttacataagaatatatgctagtacaaagttttttcaaatggataaagtattacacattcacattttaacatgtagaagtgaagcaacaagatgaaaataataccaagatctagatataaggactagtattagctcttctaagtaaagttttctgtactccagttttcttcctcattaggtcattttgtaaactcaaacactatttctctctctctctctttttttttttttttgacagggttttgctctgctacgcaggctggagtacagtggcatgatcatagctcactgcagcctccaactcctgggctcaaatgatcctcccactatagcctcctgagtagctgggactacaggcatgtgccactacacccagctaattttcttattttttttgtggagacaaggtcttgctatgtcctctggctggtctcaaattcctggactcaagtgatcctccagccttggcctcccaaagttctgggattacaggagtgagccacctgcctgccaaaaactacttcttacatacaaagtatattatagttctttcttaactgacctattagcagcatttgacagttgatctcttctttttttgaaatcctttcttcatttggcttccagaagaatatcaagctttcagggattttttttctctgaatattccttctagtttcccttcccttgattcctcctcatctttctgtgaccacatccttctgacctccccagagcccatttatatatatgtgtgtgtgtgtgtgtgtgtgtgtgtgtgtgtgtgtgtgtgtgtgtgtgtatatatatattttttttttttcctgagacggagtcttgctctgtcacccaggctggagtgcagtggtgcgatcttggctcactgcaacctctgcctcccaggctcaaccagttctcctgtctcagcctcccgagtagctgggattacaggcgcgcaccaccacgtctggttaatttttttttttttatatttttagtagaaatggggtttcaccatgttggccaggctggccttgaactcctgaccttgtgatctgcccgcctcggccccccaagtgttgggattacaggcgtgagccactgcgcctggccaatttttagacttctatttctattaacacatcctcctttggagatgccatcctgcctcattgcttcacgtataatctaaatctgataattaccaaatttacatttctggctcagacctctttcttaaacatgaatgttcaactctttttttgagacagggtcgcactctgtcacccaggatggagtgcagtggcaagatcacagctcactatagccttaacctcctgggctcaatgatcctcccacctcacccccctgccgcccccatatagctgggactacaggtgtgtgccaccacacccagctaattttttgtttgtttgtttgttttagatggagtctcgcttttttgccaggctggggtgtagtggtgcaatcttggctcactgcaacctccacctctcaggttcaagtgattctcctgcctcagcctcccgagtagctgggactacaggcgtgtgccaccacgcccaggtaatttttttgtatttttagtagagacggggtttcaccatgttggccaggatggtctcaatctgttgacctcgtcacctgcccgccccggcctcccaaagtactgggattacagggatgagccaccacgcccagccccaatttttaaaaaactttttgtagagacagggtcttactgtgttgcataaactggtctccaactcctgggcccaagcattcctcctgcctcagcctccaaagtgtttgagttacaggcatgaagcaccacacccggccaactttttacttgatatttccacagaggcatctcaaccaacactgtatccttttcttcccctgcaaacttgtttcttttgtagtggttaacatatcaataaatggctactccatccttccggttgctcaaactaaaaatcttaagttattcttgaatattgtctttttttataccacacatctaatttgtcagcacatccttttagctctacctcaaactatatatttagttaccgttttatactttttgacttttaccacctggaaccaagtcatcatcaccaatctcctggaatattgaaatatcttttcaactggtctctgatcatctgctcttgtcctatttagtttctttttctccccaaacacaaagagataagtgagatcatttcactcctttgttcaaaaccctctcagtgcttctcagaataaaagtcaaaaaagtcctcccaaaggtttactaggccctctgcagtctagggctgccccacctcccgcttttacctctctgacctctttaatattgtcccttgtttgttctgcttctgccccatactggctttcttgtttctataacgtagacatgttttagtcttaggacttttgtacttgctgaattttctacctgaaacacccttccctcagataatcacgtggctggcccttttacctcctttaggtctttatagtcagacatcattttcttggagagattttctcttacagcctatctaaaactgctacatcctcctgcttcccagacagtcccacatcagtgttcacagtattttttcccataaacctgtatctccaatataaatgatgtatccagttctcaagccagaaacctagtcatcattcttcccctctttctcatgccaggctaacatgtattcatcactgaatctacttgattctttctcctaaattaggagttttctaactttttttgctgtgtatccccaaaagaattttgaaaaacttgcacatttttatgctgacatctagaaattttcattttacatttaaatagttgcagtagatgtaatttcatatgtgttataaatactgatgttttaaggtaaaacagttgcatcagtcttttaaatgtgctgaatggaatttaaataccaaaataatttgatatccaccatcattttttaaaaatacacatgaaaagtgtgtctttaaaagttggaaattttacattgtcctttttttctctgtgaacttttttcattatatttcccctgcataattctaatatgatatttttagatttaagtctttaatcgcacttttttatttatactccttacaacaacaaaaaagtctacatattgaatttaaaaggattttccctacaaccgtaaagctttaaaacctgtcttttgaactgaattattattattattattattaaagtctcattctgtcacccaggctggagtacagtggcatgatcatggctcactgcagcttcaacctcccaggctcaagcgatcctcccatttcagcctcctgagtagctaggactgcaggcacatgccaccacacttggctaattttttaaaaatcttaaagatgctttctttttattttcatgggcctgtcccctcaggaggatgtatttttccactaggctagaggatggaagaggcaagatacttaaatgaaaatatttgtaattatctctttgtttagtgtctaggatttatttattgcacttcagagcaacatgtatcctatagagaatttcaagataagtgagagatctgcctttcttagtaaaatgagagggcaactgtgaaaacaggtataaaaggagaccctgctttactcactgtgtgcaggcaccttgtcaggcagatcttctttaggaaagagtacatatggctgtttagaaagtgtcctgacagacgtgggtgtttggcctgggaatttattaaacataagtgaatgaaacaaatttaatagcgatcttttcccagttcacaggggaaaaaaagcaattattttttcaattttatttttcttccataaattagaaaaaaaaatctttgttgtctgctgcaatttacttgctagtgagtagtgaaagattgtaaaataaatgagcgaatgatcatggaggttttaaagggaaaatggcttttaatactttttggtttttttcttagaaacatgttcctgtagtttgattttaagttttaaagtcattactagcattgtccctgctgtgatagaatatgagtcttaaaatttcacgttctgcaaagaacactgatttccaaatgatctgccactggaacaaattgggaaccatttttctagcctgtactgtcttgggtttacaagcaaatgacctgcctttatgggaaggtgcttctgggtcataggccattcaaagaaaactttgatgacaaaaatttttgcttcagctaatcttttttacatatttgattatattatggtaagctctcacctaatattaagtagaaatagcttcttggcctgtacttatctgcattttaaataaacttacattgtgaaagcctgctgaaagtacctaattaagagcatggactctgagaattattaatggacagtgggaggaatagagaaacgtaagagagggaattccttcatttataatgttgtatgagaaccaggtctccagatacatttccagtgaaatgaaaacaaattttatggagtttaaaattttttccagtatccagataatttcagtgaggccaagagatctgtttgctgctgtgaatctatttaacaagtatttactgagtgctttctttatgcagggtctgttctttttttttttttttttgagatggagtctcgctctgtcgcccaggctggagtgcagtggtgctatcttggctcactgcaagctctgcctcccgggttcacgccattctccttcctcagccaccctagtagctgggactacaggcgcccgccaccacgcccagctaagtttttttttttgtatttttagtagagatggggtttcaccatgttagccaggatggtctcgatctcctgacctcgtgatctgcccgcttcggcctcccaaagtgctgggattacaggcgtgagccaccgcgcctggcccaatgcagggtctgttcttttaatgacatactagattacctgtatgctaagcatacaggtgtagggaaataggaggaggagaccgaaaacaagaaatgggagctggtgtggtagtgcccacctgtagtcccagtcacaagggaggctgaggtggaaggatcacttgagcccaggagttcgaggcttaacagtgagtggtgatcacaccactgcactccagcctgggtgacagagcaagattctgtctccacacctctcccctgccccccaaaaaacaaacgagaaatggttcctgatcttaatgagtttagagtatgcagctgtggtttcaatttttaattatacactttgattagaaaaatgttgccttagaatattatattttagaattattttttaaaaccttactgggatgtaattgatataaagtatatatttacagtacatatatttacaatgtacaatttgatgttttcaacaatgtgataagttatatatacacagtaaaaccatcccagtaaagctagtagacatatccttcagccccataaatttcctcttgactgtaattctccctcctatttctccccactctcaggagacatcccaagccatcactaatctgttttctgtcattatcgattgcattttctagagttttatattaatactgatagaatcatacagtacatactcttttttttcaatctggctttcagcatgattattttagattcatttatgttgcatgtatcaatagttcattcctttttattgctcagtagtgtattccattgtgtagatatactgtggcttgtttatccattcacttatttatgtacatttagtttttcagatcttggctattcaaataaagctgctatgtatatttgtgtacaagtctttgtatgaagatatgtttcaatacaaagaatggaaattgctggtaattaccaaagagtggttggatcggatagtaggtggatgcttaacttttttttttttttgagacgaaatcttgctctgttgccaggctggagagcagtggtgtaatcctgactcacagcaacctccgcttcccgggttcaagtgattctcctgcctcagcctcctgagaagctgagattacaggcacgccccaccacgcccggctaatttttctatttttagtagagacagggtttcactgtattggccaggatggtctcgatctcttgacctcatgatccactcgtctcggcctcccaacgtgctgggattatagccatgagccaccacgcctggctgcttaactttttaagaaactttcaaactgttttctaaagtggttgtatagttttacattcccaccagcaatataagagatcctgttcctcctgccaatacttggtaatttaattttagccattctaatagcagtgtaatggtactttgtggttttagtttgcatttccctagtgattaatgatgttcaacatctttcatgtttttatttgccttccatatatcttctttggtgaagtgtttgttcagatctttggcccatttttgttgagttgttttgtttttttgtttttgtttttgtttttttttggggggatggagtcttgctctgtcgcccaggctggagtgcagtggcacaatctcagctcactgcaccctccgccttccgggttcgagcgattctttcacctcagcctcccaagtagctgggattgcaggcacccaccatcatgccctgctaatttttgtatttttagtagagacaggattttgccatgttgcccaggctgatctcaaactcttggcctcaaggaatccacccaccttggcctcccaaagtgctgggattacaggcatgagccatctcactcggccttttttttttttttttttttttccttttatcgaagtttcattatataccattctcttaatactatctttttatctttttctttctttctttttttttttttgtttttaagagatagggtcttgctgtgttgcctaggctggtcttaagctcctggcctcaaatgatcatcctgcctcagcctcccaaagttctgggactacaggcataagccactgcacctggcctatactatcttttggagaccaaaagttttttttgtttgtttgtttttgtttttgtttttttgagacagagtctcgctctgtcgcccaggctggagtgcagtggcacgatctcgattcactgcaagctctgcctccgggttcacaccattctcctgcctcagcctcccgagtagctgggactacaggcgcccgccaccacgcccagctaattttttgtatttttagtacagacggggtttcaccatgttagccaggatggtcttgatctcctgacctcgtgatccaccggcctcggcctcccaaagtgctgggattacaggcgtgagccaccgcacccggccaaaagttttaaatttttatcaatttgtttttttagggactgtgccattagtgtcatatcaaggaaatctttgcctaacccagggttacaaaaattttcccttctagaaattttttatttatttattttaattttcaaaaatagagacagggtctcactatgttgcccaggctggtctcgaactcctgatctaaagtgatcctttgtccttggcctcccaaagttttgcaattataggtgtgatccaccatacctagcctgttctagaaattttatagtttaaattttatatttatatctatgactcatttgaatcactttttcttttttaaaaaaatctcaccttgtcttatggtgctgattgaatcattttatatatggtgtgataattctgtatatggtatgtttgtttttttgtatatggatatctggttgttctgtcaccatttattgaaaaggctgtccttttcctttgctaaaggtcttcatgcttttatttaaaaaatcagttgcccatatatgtgtggttttatttctggattctctattctgttctattgattgttttccttatctttatgtcagtgccgtactgttttggttaccatagctttatagaaatccttgaaatcaggtagtgttagcccttcaactttgttcttctttagagttgtttcagttattctaggacctttgtatttccatgagaatgttttaatcaacatatcaatttctacaaaaaagcttgctggaattttgattgagattgtgttgcatctacagatcatttgggaggaattgacatcagaacaatgttgagtcttccaactcatagtttaatctcttcatttatttaagtctttaattcctatcagcagtatattgtatttttatttttatttttatttattcatgtttattgtattttgtttttattttttgatattgagtctcactctgtcacccaggctggagtgcagcagcacgatctcagctcactgcaacctctgcctcccgggttccagcgattctcctgcctcagcctccagagtagctgcccagctaatttttgtacttttagtacagacggggtttcaccatgttggccagcctggtctcaaactcctgacctcaggtaatctacctgccttggcctcccaaagtgctgggattacaggtgtgagcaaccttgctctgccagtattttgtagttttagtatatatacttcaactaaaatttttattttctttttaaattgaattttaatatttcataatgggctgggtgtcgtggctcacgtccataatcccaacactttgggaggctgaggcaggcagattacctgagctcaggagttcaagactagcctggccaacatgatgaaaccctgtctctactgaaaataccaaaattagctgggcgtgatggtgcacacctgtagtcccagctacttgggaggctgaggcaggtggatctcttgaatctgggaggtggaggttgcagtgagccaagattgctgccactgcactccagcctgggtgaaacagcgagactccatctcaaaaaaaaaaaacaaaaaaaacccaaaacatttaataatgaaaacattgccagtattcttaattgatgtttgagatatttgcatccttgtggaaatcttggcagcacaatgaagaatttggcaaaaataaatatcagtcagactctatatccaaaaggatttatttccacattgtacctgaaactcaaatgttaattactgaacaagtgcattagcaagatttttaatttaaatgtgaagatggaaaactgaaaaatataaattaggaaataacatttctataacttgtcaaatgtagtggtttatcagggtaaaaagttaaagtgcttttgtgtgtgtctacacatggatttatagtatgagactattttgttttttgtttttttttattatactttaagttttagggtacatgtgcacattgtgcaggttagttacatatgtatacatgtgccatgctggtgcgctgcacccactaacaattctatttatagtgttacagtaaggaaatgccttctggcaatttgaaaatatggtgtaactaaaatacaggtctgacttgttaatctactgttaaagactggaaattattttaattgctctttttctgactaggctttcaaaaaatatgataggcaaattggttctgtcgtggtaattttatgtttactgtctctgtagaagtgtaaagcatggttctcttccattgtcctcttgatgtcctgttacagcatttatgggtgagattttaacattgtgtgtttatttttatgactgttttcatatttgaaattaagaagtttggcataagaaactttgatgcttgatgttcaaattgctttgtagcttatttaacaaaatcataatcacagaaaaagaatccatcccagttagacattatcttaattctcatgttcaatcattttcactgagtggggcccttggctttttatggaaagatgttataagaaacaaccttgccgggcgcggtggctcacgcctgtaatcccagcactttgggaggacgaggcgggcagatcacgaggtcaggagatcaaaaccatcctagataacacagtgaaaccccgtctctactaaaaaatacaaaaaattagccgggcatggccgtgggcacctatagtcccagctactcgggaggccgaggcaggagaatggcgtgaacccgggtggcgaagcttgcagtgagctgagatcgcgccactgcactccatcctgggggacagaacaagactccgtctcaaaaaaaaaaaaaaagaaagaaagaaacaaccttgcctcagggaggggggcctgaggaggcaggaggattgtttgagccaaggagttggtgaccagctcgagcaatttaggtaggcctcatctttaaaagaaaaagaaaaaaaaaaaaaaaaagaaacggccttatgaagtctactgccacacttacaatgtaaatgtttatttatttatttaaagatggagtctcattatgtttggaagcctgaaactcctcggcccaaggaatcctcccacctcagccactagagtagctgggactacagacaccccactacgcctagttaaatgtctacttttttaaaaatgtcttttaaaagtcgattgatctattagaaatgtatggctaaaatgtaattaagttatctctggctgtgttaaagaagtgcagggtataagaggaaatatttatttctccaaaacctaatttgaatttattagaaaatatgttagaaacatatttctaacatagaaatacattagaaagcctgattttttttttttattattggtcctatatgaatttctaattgccttactgctagactttttggaccagacttcttcaaagagtagtctttccttactatggccttccacttccccattccccaattcaaaattatttttctttatcaattagtttgtattttgtcaaaattatttatgtaaataaaaagataattcgctctgcaaagcttgttatgaaaaatagcattacttcccccttaaacacaaaattttctgtttcctagagaaaaccattttaacttttcaaagtgatttatttacttctatatttctaagaaagaaaaagtgcttatattgctatttcatgtttttttctgttttggatgttatctgttgacttcctaccacggagggtaaggatttaatattctcttttttctctttttttttttttttcttggcagggactcactctgttgcccagactggagtgcagtggcacaaaggatttaatattctttaatatgcacatacattcccctccaaccacacacacactttccactttctcttcccccacttcaaagttatatcttaatttgagttggattaatattcaaagtttacattattatgactgtaaatgctatttttggggtttttttttggggtgggggggacagggtctcactctgtcggccaggctggagtgcagtggcacaatctccactcacctcaacctccacctccagggttcaagctgagattacaggcacgcaccaccaggcccagctaatttttgtatttttagtagagacggggtttcactgtgtaggccaggctggtcttgaactcctggcctcaagtgatccacccccaccttggcctcccaaagtgctgagatcataggcatgaaccaccacacccggcctataaatgctatttaatctgctttttcttttctaactcactgcttttactggagttattaattatcttgttttcttgtttgtgtgtttttctatgtagtacacttattaccaaattcaaactttttaccagttttctaaatatcctatcaagattttcatcccattgcatactctgtcaagtttgttttcttgagacagtctctcccagagccttctgacctgcaccagtgtggactggtcacctttattcctgttttacagctctcatcctataatttcctttcattttatcctgggcattcctttgacctttcttctctattgattcctttattttctttattccatatttttctttcttgattcatacccttgttttagtgtagtacaaatgacagaaggttaatgagaaagactacgtgagagataaagttttggaccttattctatctaagaatgtcacgttagcatggcgtttgatattgctggtatcttggattccaggctgaacatcattaccatctagcttctagtattactgttgaaatctgaagctaatgtctgcttctcatatataatctgctcctcctcacttccctgtcctcccagtcttgtaggatattctctttgtctccagggtcctgacattaaaattttgttcagtgacatgggcactagaaaagccctttagacttattttattgataatttcccccctcaatttcctctgtttgctagatgattctcaaacttttgaaaacctcatttatggtgaagtgtaacatataatcagaaaatgtgtaaaggataaatatacagtttaaggaacacctatttaacactcaggtaagaagacagaacattgtcagcacttttctcaggataactctccaaaaggtaaccgtttttgtggtattcactgttttgattttctttctttttgagacggagtctcgctatgttgccaggctggagtgcagtggcatgatctttgctcactgcaacctccgcctcctgggttcaagcgattctcctgcctcagcctcccgagtagctgggactacaggtgtgcaccaccatgaccagttaatttttgtatttttagtagagacggggtttcaccgtgttggccaggatggtctcgatctcttgaccttgtgatccgcctgccttggcctcccaaagtgctgggattataggcgcgagccaccgcgcctggcctgttttgattttcttaatagtttttccatctcagcgtgtatcccttaacaccattgtttaatttgttctgaatttgtttattttttatttttgtatttaattttgtctgactttgtgaatggaatcccattgtatgtattctttttatctggcttctttctgccaacattttttcagggtgcatccacattttatgtagctgtcattattactgcatttttttgactgtgtgtattccattgtattaataagccacaatttatctgtcccattctggatgaatatttgaattcttttctagttttggaaggtattattaataatgttatttatgagccttctagcgtatgtcttctggtaaacatttctctagagcattgctgtctagaagagatacaatgtgagccacacatgtaatttaaaattttccctcctaggctgggcatggtggctcatgcctgtaatcccagcactttgggaggacaaggcaggaggattgcttgagcccaggagttcaaggccagcctgggcaacacagcgagaacctgtctcaaaaatctaaataataataataataataattaattaaaaaataaataaaattttccctcctgagtgaattaatgcaggaacaaaaaaaaaacaaatgctgcatgttctcatttacgggtgagagctaaacatggggtacccatggacataaagatgttaacaacagacaccggggactaatagaggaggtagtactatgctcagtacctgggtgatgggatcatttgtaccccaaacctcagcatgacacaatatacctaggtaacaaaatctgcacatatacccccttaatctaaaataaaagttaaaaacgaaaattatcatagccacagttgaaaagtaagaagaaacagatgaagttgattttaataacatatttttaacccaatctaatcatttcagcatgtgtcataaaaattgagaatttgacttcttattttaatactgaatccttgaatctggtttgtattttacaccaacatcccatttcaactcagtggagctacatttcaggtgttcagtacccacatgaggctagcgtctattatattggactgtatagctctaaagaaatatatgtaaatctatcctgaatatatatatatatatcctatagtggaattgctcagtcatagactatacatatcttgaactttagtacttaatggcaaagtttttgaaagtgattgaaacattttacattccagtagcagtgtgtgatcgttcccattgctccacatagttaccaacatttgatattatcagaatttttagttttgctgcctggtgagtggatagttttcatggtcgtttaatttacatttttctgattacttaagagctagagcactttttaatatatatataggctatttgaatttattcttttgtgaagtgctagtttaagggttttttgcccattttttctcttgggatttttatcattttttttcttactgaatttttaggagttctctatatattctagatatgagccttttgttacatgtactacatatatcttctccaactctgtaacttgcctttttactttcttaaagatgtcttttgagaaacctaaattttaaagtttaatataaagtttatcagttctttccttcatagctagtaattttttgtgtcctatataagaaatctttttcaatcctgaaatcatgaagatattatctagttttacactgtcagagctttattgggtatatttatttattaggcctaacatgcagctaggattgatttttgggtaaaggttgaagtaggagttgattttctttttctgcagtggttcaacactattcatacacttccctgcctccctgcaactctctgccacacctcatactctacagtgccatctgtgtaaataagcgtctatatatatgtggacttgtttgtggactctgttatgtcccattgatttctttctctatccttatgccattgtcacattcttcattactatagctttgtaataaatcctgacaaccattggagcaaatccttgtacttccttacagacatatgactttgttgttagtaattttaaaaaaagaatatatgactgattttcttagctttttgcacttttatttacatgttgaaattatcttggcatttttagcaaaacaacctgcttggatttgattgtgattttataactgcatgtatcaattttgagagaattcagttgtatacaatattaagtctgacagttcaccaacatggtatcatctttcatttatttagctctttaatttttcttaaagtctagttttctccctaggagtcatgtgtaccttatcaggtactcaaggtacacggtattttaaattctactgtaaatgctatttaatttttttttttttgagacaaggtctcactctcacccaagctggagtgcagtggcataatcatggctcactgcagcctcgacctccgggttcaggtgatcctcccacatcagcctcccgtgtagctgggactacagttgcgtgccaccacatctggctaattttttgtagaagtggtgtttcaccgtgttgcccagactggtcttgaactcctgggctcgagcgatcctcccgcctcagcttcccaaagtgctgggattacaggagtgagccaccgcacctggcctaaaaattttgtttgctagctttgttgctggtacatagaaagaaaagtttattttttatgagttcaggtaatttatgtgtacaatatttttgtcctgcatgggtacattattttgtcctccatgggtgcatggattcttcagagaagcagaaccaataggagacacacacacacacacacacacacacacacacacacacacacacacacgacatttaaggaaataggctcatgaggttatggtggcccagaagtccaagatctgcatttgtcaagctgcagacccagaaaagccaatggtataattctagtcctagtctgaaggcctgagaaccagaagagctgatgatataaattccagtctgagtatcagtctgaaggcagaagaccggtgtcccagctcaaatacagtcaggcagagagaaagaattctttctcagccttttgttctattcaggcctttagtcaagtggataaggccacactggggagggtagtctgcttttctcagtctaccaactcaaatgttaatctcctccagagataccctgacagacatacccagaaatagtgtgtaaccagttatatgggcaccccaaaattaaccatcacaatgggcagtcagatgatctgcaaatttgtttcttctttaccaattctgaaattttctttttcttggtttactgcaatagccaggacctccaaatataatgtggaatagaaatgataatagaaaatatccttttccttgatctccaaaggaaagctgtcagtgtcttgtcttactattaactatgattttattgtagctttttttgttttgttttgttttttctttgagatggagtcttgctctgtcgctcaggctggagtgcggtggcatgatctcagctcactgcaacctctgcttcccagttcaagcgattcttctgcctcagcctcccgagtagctgggactacaggcacctgccaccacaccggctaatttttgtatttttagtagaggcggggtttcaccgtattggccagggtggtctcaaactctgaccttgtgatccccccgtctcagcctcccaaagtgctgggattacaggtctgagccaccgcacccagcctattgtagctttttagtatacatcctttatcaaatgaaagaagttcacaaagagattttttatttgtttgtttgagacagagtctcactctcacccaggctggagtgcaacagcacgttatctcggctcactgcaacctccgcctcccgggttcaagcgattctcctgcctcagcctcccaagtatctgggactacacgcgccttctaccatgcgtggctaattttttgtatttttagtagagatgggatttcaccatgttggccaggctggccttgaactcctgacctcaagtgatccacccgcctcggcctcctaaagtgctgggattataggtgtgagcctccgtgccgggcccacaaagagattttatcatgaatgaatgttgaatatttttcaaatggcttttttacatatatattgggatggtcatattatttttctttttttcttttcttttttttttttttgagatggagtctcgctcagtcatccaggctggattgcagtgatctcagctcacggcagcgtctgtctcccgggttcaagcagttctcctgccttagccacccaagtagctaagattacaagcctgtgccaccacacctagctgatttttttatttttagtagagacggggtttcaccaggttgtccagtctggtctcgaactcccgacctcagatgatccacccacttccagcctcccaaagtgctgggattacgagccaccatgcctggctgtgattgtataatcttatttgtatacattatggaatttagttaggtgacactttacttaggcttttttttttttctggattcataagtgaaaatggcctataattttgttttcttttagagatgaggtcttgctcattcccccaggctggagcgcagtggcaccatcatgtctcactgtagccttgaccttctgggctcaagtaatccttttgctttagccttctgagtagctgggactacaggcatatgccaccatgcccagctaatttttttattttggagagatgaggtcttgccatgttgcccaggctggtctggaattcctggcctcaagcgatcctctgaccttggcctcccaaagtgctgggattacaggcatgaaccactgtgctgagctaaaaatggcctataattttcatctttctttttgagtttttatataaagtctagtcccaaaataaattggagagtatctttttaaaaaaaattttctaaatgttcgcttaagattgttgtattgcttcctttatgtttgatgagtttgtcaatgaagccaggtagacccatataatgggctataatgcaagtctcaacaaatttcaaaagattgaaatcatagaaaatatgttttctggccaggcatggtggctcatgcctgtaatcccagcattttgggaggcagaggtgagtggatagcttgagctcacaagttcaagaccagcttgaggtcaaggctacagtgagccatgattgcactactgcattccaacgtgggtggcagaatgagactctgtctcaaaaaaattaaataactaaataaaaatgaaaaagaaagtatgttttctgacgacgtgattattatagaaatcaattttaaaaaccttttaaaaaatctcatgtttaaaaattaaagaaatttgcttctagattcttaaggtgaaagaagaaaccataatggaaattagaaactatagtccaccattcttatccttgggttcttaatccatagattcagccaacctcagatcaacagtatttgggaaaataatggatggttgcatttgtactgaacacatacagacttttctcttgtcattatttcctaaacaatacaatataaccactattacatagcatttacattgtattaggtgttacaagtaacctatagatgatttaaagtatatgggaggatgtgtgtaggttgtatacagtgttacaccattatatataaaggacttgggcatccatggatttgggtatccacaggtgtcctggaactaatttcccacagacactgaaggatgactgtattttgaactggatgattacaaaaatattccatatgaaaatatgtgtgtttttacaaaagtagttttagagaaaacatacatattagaaaagaaaggttgacaaaaatgagcaaagtatccatctcaagaagttggcaaaagaacataaaaagcagaagaaataatgaagataaagcaaaaataaatgaaatataaaacaaacataaaataggatcataaaagccaaaagttggttctttaaaagattaataacattgataaacctctgagatgctgatcaagaaaagaacgaatacacaaataactaatattagaaatgaaagaagggatttttactataaatcctatagacttacaaaatatgaggctataatgcacaattttatgctatttttttttttttttgagatggagttgcccaggctggagtgcagtggtgcgatctctgctcactgcaacctctgcctcccaggttcaagcaatcctcctgcctcagcctccttagtagctgggattacagacacgtgccaccacacccagctaattttgtatttttagtttcaccatgttggccaggctggtctcaaacttctgacctcaggtgatccacccacctcggcctcccaaagtgctgggattacaggtgttagccaccgtgcctatgctaattttttaaaactctcattttgttcaggcatggatctcttaggaaatggcaaagtctaaatcgtagactaatcattgtttggcaatggttggtttagtggtggcacgtgatgtgatgttaggaagaattctatggtaaattttgagacttcaaataaaatggttaacttcaatgctgtgttttttgtggggagggttttaaattacttttgcttaactatgaggctattcaagttatctatttttgtgttagtgcttctgatatccttctgacttcatggcataaaaagttaaagcaggctgggtgcagtggctcatgctataatctcagcactttgggaagctgaggtgggaggatcacttgagcccaggagttcaagatcagcctgggcaacatggtgagacttcatctctacaaaaagttttaaaaattagccaggtcatggtggcacacacctgtagtgccagctacttgggagactgaggtgggagggttgcttgaccccaggtctgcagtgagcctgggtgacagagtgagaccctgtctcaaaaaaagaaaagaaaggaaagcaatacttttttaaatttctttcaacaaatatttataggacacctactgtatgctaggtactattatttaccatatttcttatatccagtcagactggattattatttaggacagaaaatttagaaacaaaaacggctcatccctagaaggatgcagctgcttaaaaaaaaaaagaaagaaaaaaaaagaaaaaaaggtggggtgcttagcatagctggtggtgacagtgctattgtgaaagctgagtagcacctatttcacagagcacctctataatttgtaaaggagtatggtttttcagatgttacctttattactgggattcatgacctgcgtagacttcaagtaggtttattgacttcagggtatccacagttcctctgaaattgtatagaatagtttatgtgtatatgctttttggtgatagggaagagagggttcaatggctttccatagatttttcaaagggtccaaaaatgcttaagaaccactgctctgtgggttaagaaaagtttacagagaccaacaaatagtttttttcttcattttgtgttttatgtctgttttgagtaaccattatagtaaaatattatatataagattctctttgacttttgttcaatttatattattttgccattactttaactgataacttttttttaaaggttcaggaacaagtgcatcccactctctcagctaatgaagagtctctctattatattgaagagctgatttttcagctgcttaataaattatgcatggcccagccaaggactgttcaagatgtagaggtaaaaattattttgtcatttcaaaaagtcactcaaccactgtatgaattaatttttgtatctatatcattctaatttattgtgaaaactaaaaccactgaaattatgtatgatatatatggtcagtttgtttttgacaaaaatgtcaaggcagttcattgaggaaaggcaagtttttcagaaaaaaaaaaacttagaacaactgggtacatttatgaggggaaaaaaccttgaaacctatctcatgccgtagacaaaaattaattcaaaatggatcatggccttagacataacagctaaactacaaggtttctagaagaaaattctggaaaatatcttcataacctgggtttaggcacatattttttagagaggactcaaaacatagtactttatattgaataataaggccaggtgcggtggctcacacctgtaatcccagtactttggctgaggcgggagaccgtctcaaaaaaaaaaaacaaaaaaaaaatgttctctatgtcagttgagatgatggttacacagacataagcatttctaaaactcaacaaattgtacattttaagatctgtgtattttactgcatataaatattacctcaataaaagattagtgtaaattttgaggacatttgctcagtgatttaaaaaaatgtatatgtatgtgtgtgtgtatatatatatatatatctgaaaaactgtttaaattagtactaaaataattgttttgccttggttacatgggagtatttttggatttttagcaatatctgttagggagagttttacttcttttgtataaaagcaccctgtgcacataaaattaatattaataaaattggtattattttctcctgctaaaaacaaatgtctaatagtacagctatcaaaaattattttcatttttattttttgagatggagtctcactctgtcgcccgggctggggtacagtggtgtgatcttggctcactgcaacctcagctacccaggttcaagctattctcctgcctcagcctcccaagcagctgggactacaggcgtgcaccccaggctaatttttatattttcaaaaattacttttatactatactgtttacatttcctttttttttgaaatttgtttctataagcaacaactttctttctttctttttgtgaagtggcatgatcatagctcactgtagccttgaactcctgggcccaagttgtcctccagcctcagcctcccgagtagctgggactacaggcacgtgtcactgcgcccagctaatttttatttttatttttgtaaagactgggccttgccgtgttgcccaggctggtcttgaactcctggccttcagtgatcctccctcctcagccttccaaagtgctgggatacaggtgttagccaccatgcccagctacaacaactttcagtataaaggaaaatcttaatttgtagtgattgagctattaagattttccaggattcttggaattaaagcatttttttcccctgttctctgctgccaattgtttgggttttgttgtgttttgttttaagagacagggtcttgctttatcacccagactagggtgtagtgacaggatcatagctcactgtagccttgaactcctgggatcaagcagttctcctgcctcagccttccaagtagctgggactacaagtgcatgcaaccatgcctggctaatttttaaatttttttgtagagacagggtctccctacattgcgcatgctggtttcatactcctggcctcaagggatcctcccacctcagtctcccaaagtgctgagacttagaggcatgggccaccatgcccagcctctgctactagttttgaacatgaaataaacagactgaaagcatatttttcaatagctaaatttgctaaaatctgagactataactataaatataggaaaccctgctaaattagagtttaattcagatctcagtagttcttgtttttcatgccaatgaatcactgattaaattaaaattagatgaactgcctaggtgcagtggctcacacttgtaatcccagcactttgggaagttgaggtggacacaatcacttgagcccaggaatttgagactagcctgggcaacatggcaaaactctgtctctacaaaaaatagaaaaattagccaagagtaggggtatgtgcttgtagtcccagctactcgggatgctgaggtgggaggatcattggagtctgggaagtggaggttgcagtgagctgagatcccgccactgcacttgcacttcagccagaagtgacacagacagagtgacaagagtgagaccctgtctccaaaaacaaaaaagcaagatgaacacaaaggctaagattgtttttgtcaaggtacgtattttcataagccattctgagctctctcacccatttcatcttccaagagatacatgacctcttttatttgaagctctaagattaacgaaaggagagtggctgtatactaatgattaaaaatgaatgaacaatttctgctctgctaggtaaatagttttaactctagaaacctaacttaaaatcactaatacactatttcatgttcgctttaatctttcttatatatcctatgtattgttttttcctttttccggttcatcttaattatgtttaaagctttctttttgaagtttacctttttgttttatccatgaaaattatgtggaaaaattttgatagtcctgttgacctttttttttttttttttttctgttgggggtctccctctcacccaggctggagtgcagtggcatgatctcggcttgctgcaacctccgcctcctgggttcaagcaatcctcccacctcagcttctgaagtagctgggactataggcatgcaccaccaccatgccgggctaatttttgtatttttaatagagatggggtttcaccgtgttgcctggctggtctaaactcctgagctcaagtgatccacctgcctcagcctcccaaagtgttgggattacagacgtgagccaccgcgcccagcctgaccttttttttaagccaaaaaatttatttattacaggaatcagaatgtattgtgtcactattatctgctagcattaagaatagagatcaagttgaattttgtatgaatttcctatttatgaacacttttattaatactacaatggttctgctgtgattgagcaggagcgagttcagaagacctttcctcacccaattgataaatgggccattgctgatgcacaatctgctatagaaaaacgaaaacgaagaaatcctcttttactgcctgtggacaaaatccatccttcgttgaaggtaacaaaagattaaacattagttggggggtgttctttataacaagtaatattttatttctatatttataaagcattaatgtagcatggtctgtgttagtgtgtatatgtgcacttccatatgtatgcttgtacatacacatcgcatatattaatatgtatacaaaatgattatgctctggtgaaattggattgcttttcaaacaatattaaaaattattaatagtgataatgcattactattattttgtggcatcttttttttttttaagtagagacagggtcttgctgtgttgcccaggctggtctcaaactcctgggctcaagtgatccacctacttggcctcccaaagtgctaggataagagtcatgagccatcaggcctggcccattgtggcatctttatggcatcttccaatgactgctactctgactaattcctatgtagtaggccatgattctcagtcatttgttgattaagaaagtgtataatttcagaagctactgtgagttcagaactgtctttaaaattaatttatattatcacagattattttttatatactggaaaagtggactaggacctagtttggctattgcatattaacgcatagggcaaaatatgtttggtgtatatggattttaagagttttgtagcaaattcaagccccccccgccccgcctgcctcacacacacagacacttccatacctcccctcagtagaaactactgtaattaggggatactggttttaaagcagagtccttgaagatagcagatattttgatatttgtcagatgaattttggttaatgtattaagaggcttttagtggagtccaacccaagatttctatatcaagatcaactgttgttgtttgataaaaggcagagttgttagattagatgtctcttaaaagaaaaaaaatcccctaatacagggaccaaagattcattttatatcccgtggtacccatacatttagacatgtagttaatagaaaattttttataagcaaggatgttaaataggaattttttaagtgtgtaatacttgacagtgctacattttgcaattaaattatttattcttttcacaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggtaagtgttacaaggtatttaaatttaacttgaatagcaactatactaatttctgcctcaatctttttgtgtacattattagataagtaatctttataattgctagtactggaagagagaaaaatcctggctttacagagtaaccgtgatatttccaggtttttaagcatatggcaggatggggatctctttttttggtcaagaatcttttacttacaagaaaaaaaacatccaaggcctcaaaacaatttaagtagtttcagttttatatttttagaaagagaatatatagagttctactcaggtacttttaagtgtaagtaattttgaagaccctactttggtttcacagcatagcttagtgaggcacaggggagagaaaattagactgcaatgttgaagttactcccctctgatcatttttttgtttttatatctgtcttctttcctggctgtaagctacttgtgggaagaaattgagtcttccatattcttctatattcctttacttaccttcttattcttcttcctgttatttgagacaaggtctcactttgtcacccaggctggagtgcagtggcacaatctcagctcactgcaaactttgcctccctggctcaagcgatcctcctatctcagcctctcgagtagctaggaccacaggcgtgcatcaccacgtccagctgtttttatattttttggagagatagggtttcaccatgttgcccaggctggtcttgaactcctgagctcaagtgcttgcctcagcctcccaaagtgttgggattataggcatgagccactgcacccactgaagctataacgctgaataacatagcaatctttgtgttagaaggtatttattttactgcaaaataaaaatattataaacagataattacagaacaatatgattaaaactatcatactagtaagtccaaggtacagtggagaaagtaatgaactttagcacgggtgaggccagaaagactacagagaaaatgcctaaatgaaactctctcagggtgaacaaccttcaggacctagcacatgctggtggttctcagccttgactgcacatcagaattaatagaaagctttttaaagaatgctgatgcctgcatatcacccccagagatttaattggcctggattggatctccaaacctcagtgttctttgaaagcattccaggtaattctgatgtgcagttataatgactgagaccgattgtacgatgccataatttcagaaatgacttttcacttacatcatggtagcaattccttgttatctctattttgacttacaaaattatggctactttttttttttttttactttgaaaatatcttagacttttagaaaagttggaagtacaacaaaaagtaagcccttgccacttgaaccatatgagagtaagttgccaatatagtatgtcctataaacaagaacattctgctacattaccacagtatgactgacagtcaaaatccaggaaatgaatacatttgatacattataccatctaactttcaaacatcattcaagttttgtcacatatcctaatgatctttttaccaaaatcattcattccagaatcatatattgtttatgtgtcatgtatttttatcgtcttcagtctggaataattcctcattcctcccttaacttcaaaaaaaaaaaaaaaaagatggcaaagcaggccaggtggtggatcacgcccgtaatcccagcactttgggaggctgaggcgggcaggtcacttaaggtcaggagttcaaaccagcctagtcaacatggcaaaaccccgtctctactaaaaatacaaaaaaagtagctgggcatggtggcatatgcctgtaatcctagctgcttgggaggctgaggcacgagaatcatttgaacccaggaggtagagtttgcactgagttgagattgcaccactgcattgcagcctgggtgacaaagcaagactgtttcaaaaaaaaaaaaaaaaaaaggtggtaaagctgactttattcaagagaggccatggcaataggcacagggaccactgcagtgtaatcctgtggttggggagagagatgttagaatcaactctcctcccttaacttctataacctggacgcttttgagagttacaggtcagttactgtgtagaatgtccctcaatttcggttttctctgttgttttctcttggttagaatcaggtaatggtctttagcaggaatatcatagaaattgtgctgtgttcttctcattgcattttctcagatggcacacaggcacatgatttcattgtgtctcattagtggtggtgatgttgacttcgatgacttgattaaggagttatctgccaggcttttcatctgtgaagttactgttttcccttttgtaattaataaatgaatattttgtggagtactttgaaactgtgtatcttattctttatcacactcaaatttaatatggactaatgaattgttattttattcaatgggtcataatctgttacttcattatttagatgttgtaggccaggcaccgtggctcatgcctgtaatcccagcactttgggaggctgagacaggtggatcgcttgagctcaggagttggagaccagcctgggcaacatgtctctacaaataaaaaaaattatccgggcgtgtgcttgtgactatagtcccagctatttgggaggctgaggtgggagaatcactggagctcgggaggttgaggctacatggaatcgagatcacgccactgcacaccagcctaggtgacagagtgagacactgtctcaaacaaaaaaaagttccggttgttccagatttggttattaggagccctagcttggtttttctgttcctgtcattatttgagcactttattttcttttccccttcctatttattaatttatttaattataaattgacaaattatagttgtatatatttatggagtacaaggtaatgttatgattacaaagaaaatgtggaataattaaatcaagctgattaacatttattacctcaaatacttattttttgtggtgagaacatttgaaatttactcttagctagtagaatgatggttacaaggctaggaaaggtagctggagtgggggaaatggggatggttaatgggtacaaaaatattgttagaatgaatgagatctagtatttgatagcacaacagggtgactacagtcaacgataatttgttgtatattttacaacaattaaaagagtttaattggattgtttgtaacacaaaaaaaggataaatgcttgaggtgatggagactccattttattctgatgtgtgcattatatgcctgcatttaccccatacatatatacacctactatgtacccacaaaaatttcttttaaaaattgaaatgacaaaaaaatttactctttttgcaattttgaaatgtaaatacattattatttactatattcaccatactgtgcaataaatcttacaaaaaagacccaattcctcctaattgaggttttgtcccccttcccttcagcctctggtaaccacattctactctgcctctatgagtttgttccagattccacatgtaagtgaaaacacatatgcattttctttgttgtttgttttttgtttttgttttttttcttttttgagacggagtctcactctgtcgcccaggttggagtgcagtggtgtgatctcggctcactgcaacctccgcctcccaggttcaagcaattctcctgcctcagcctcccaggtagctggaactacaagtgcccaccaccatgcctggctgatttttgtgtttttagtagacggggtttcactatgttggccaggctggtctcgaactcctgaccttgtgatctgcctgcctcggccttccaaagtgctgggattacaggcttgagccaccacacccagcttctttgtttttgagagcttgagtctccctctgtcacccaggctcactgcagcttcaaacccctgggctcaggcaatcctcctgcctcagcctcacaagtagctagagctataggtgcctgccaccatgcccagctaatttctaaattcttgtaggaatggggtcttgctatgttgcccaggctggtctggaattcctggcttctagtgattttcttgcctcaacctcccaagatgctgggattacaggtgttggccactgcaccaggccataaactatttttttttaataagtcattcctttatttgaagcatttttccatgtcctaaatcttcaccttttgagagtttaaaaaaatcttcatgtggcaggattttcagatccccttgttatattgcttttagactgatttctaaaactgtgaagacaatagtccagatttggtctgaccaacagagtatattgaaatgcatgtacgtatccttcattctatatgctattctttaataatttcagcattaatattttggcaccacgttactctgtgtacttgttgagtctgcagatttctaaactcccgaggactgttccacatgaagtaccattatgttaggtctttgatttctccaacttgtgcttgttgattttttgttattgttgtaagaatgaacgtgaatttatccctagaaaacttcatactgttattgaggctatgttccagcatatgtagatattttaaaaattgaattctgtcattcagcattttagatactctacccaggtttttgtaaagtgtacaagtctgataaaccttgaattaaaattatttagtaaaaatgttgaaaaggccaggtgcctttgaatctgagaggcggaggttgcagtgagccgagatcacgccactgcactccggcctgggtgacagagcgagactccatattattttatttaatttatttattttttattgttgagacagagtcttgctctgtcacccagtatggagcgcagtggcgtgatcttggctcactgcaacctctgcctcccagtttcaagcaattctcctgcctcagcctctcaagtagctgggataacaggtgcctgccaccatgcctggctaatatttttgtatttttagtggagatgggattttaccatgttggacaggtgggtctcaaactcctgacctcaggtgatctatccacctcagcctcccaaaatgctgggattacaggtgtaagcccccgcgcccagccaatactccatcttaaaaaaaaaaaaaaaaaaaaaaaaaaattgaaagggattatataagaaatgagatttccaacatatgttattagtggcattcttctaggttaaaagttaccacttttcttcattcctgccttttagttagctattatttcacattttatttaattcatgggtcaacaaactttacctataaagggccaggggataaatattttaggctttgtgggccatacgtctttcttgcatctactcttctctgctcttgtagcatgaaagcagccataaatgaatgagcatgggctatgttccagcaaaactttatttacaaaaacaggctgcaggctggatttggcctgtagtttgctggtccttgtttcagacattcctgtcatgatcccctatttgtcacaagagactgtcatatgcttagctaaaatccagatgacttggccgggcgtggtggctcacacctgtaatcctagcactttgggaggccaagacgggcagattgtctgagctcaggagtttgagaccagcctgggcaacatggtgaaaccccatctctactaaaatacaaaaaatcgtccagacgtggtggcgattgcctataatcccagctactcaggaggctgaggcacaagaattgcttgaacctgggaggcggaggttgcagtgagccgagtaccacttaactccagcctgggcaacaaagtgaaactatgtctcaaaaaaaaaaaaaatcccgatgacttgatatgtgggtctagttatgtaaccctaagtaatgagattgtatgatgtggtatgatcttagtatatccaaactgatatctagagatcactagttcaagagctcacagaccatttgtttaataaattatttgaatatatggtttctagggatatctttaatttgccagacagagaacttgagaatcaaccctatttctttacagttaaaaataaaaataacatgtggctatatgaggtattctagcatatcaaagattgctgagaattagatgatcataggaaagaaccatagaatttaacttctagtatataagttactactaatgaaaatagtatttaaaactggaaaaactgaacataaatgcttaagaaggaaattgatgtttaggaaaggtaaaggccaggcacagtggttcacgcttgtaatcccagcacttttggaggttgaggcaggaggatagatggagcccaggagtttgagaccagcctgggtagcatagcaagacatcatctctacaaaaaatttaaaaaaagaaacaaagaaagaaaggtgagataccctggggaatatagcaagacctcatctctactaaaaataaaaaaaatattagctgggtgtggtggtgcatcccagctacttggaaggctgaggtgggaggattgtttgagcctaggacattgaggctatagtgagctattattgtgccattgggcaacagtggacaaaaaaaaccaaaaaaaaggtgagagaataagagggcacaaagctgctctgaggaagcttagttcaccagatctagatatactagcagttgagttctgtattttctttcttttgtttttaacctattgaattatacttttttttttccttctgagacagactctcactctctcaaccaggctggagtataatggcgtgatcttggctcactgcaacctctgcctcctgggttcaatccattctcctgcctcagccttctgagtagctgggattacaggcacttgccaccacgcctggctaatttttgtatttttagtaaagacagggttttgccgtgttggccaggctggtctcgaactcctgacctcaagtgatctgcctgccttggcctcccaaagtgctaggattacaggcatgagctactgcgcctggcctttgtttttgtttttgtttttttttaaagacaaggtcttgctctttcgcccaggctggagtgtagtggcgcaatctctgcccagtgcaacctctgcctcccgtgttcaagcgattctcccacatcagcctcctgagtagctgggattacaggtgcgtgctaccatgcctggctaattttttgtacttttagtagagacagggtttcgccatgttgggcaggctggtcttgaactcctgacctcaggtgatccatccaccttggcctctaaagttctgggattataggcgtgagccacccatgcctggccagaaaaatctgaagctaacaggagtggggtatgaatatattttctctttcatggtagtattactccatctgtttcaagagctagcttgctcgctcctttttttttttttttttttttttttttttttttgtgacaaggactcacctaagccggagtacggtggtgtgaacacggctcactgcagcctcaacctccagagctcaagtgatcctcatgccttagcttcctttgtagctgggaccacaggcttgaaccaccatgcctggctgtgtttaaaatttttttgtagaaactgggtctctctttgttgcccaggctggtcttgaactcctgggctcaagcaatcctcccagtttcagactggtgaccttctagtgaatagggtctctaggtttgttttttaaatttttgaattatttgccatccatttatatttacagatctaaaaattttacataaaaatgtaaatcccagacttttcatgaaaaaagaaaatcagaatgcctaacagaaaacagctggcactgagcagcacacttcctctttaggtgcatgtaccttccggtttaccataatccccactgtttcttatatattataatgttacttgcctgacccctgtagcatttaaattcaggaactttggtattatgtgaccaaaagagttttaagaatggaactctggagtgggtggtagagaaggtaagtcatagaggaggccccactgacagaatggtgtatcagaagccaagaagagaaaaattgtttggagctggggggtttatatgtgttttttcttatttagagataggatctcattctgtcactcaggctagaatgtggtggtacaatattagctcactgcagcttcgaattcctgggctcaagtgattctcccacctcagccttcagagtagttaggaccgcaggtgtctaccagcatacctggttattatttttttttacttttggtagagatagaatcttgctatattgcccaggctggtcttgaatgcctggcctcaagtgatcctcctgcctcggcctcccaaagtgctgagattgtaagcatgagccaccatgcctcgccctgagagttttaagagttttaagaatgagagaatggtcagctgtgtcaaaaactagagaaaacaagtaggaagactaaaacacaccattagatttgacactagatcaatagtgagagcagttttaatatagtaatgggcttgctaagtgaatgggagcaagaagttacagctagcaagtatgacctactctaaaagggtctctggtggggaagagaagagggtggtagctcttctgtgtgtttttatgtcttatgtcttcctttattttgcatgtctgtttgaaatcagagttcatcaccaaattccctgtgtagccttactggtttctttaaatttaaagtggctgggaagtggggatgatggtctccaatgacaagaaggtggattgcatggagtaagcagtggggaagggagggatttgagagtgtcacagaacatgagattaggaaggtgggttggagttaaattatgaatggcctttatcctaaagaagttaggattttatgcagaaggcaatgaaatccagtatcatttttatgtatcatttatttttagtaacatgattttagaactggggttgggaagacctgtggcaggcagatcaaattatgaaacttgtgtatctttttaagagatggtgattgtttagtggagtaatctaaagcctgcggtaagatggagagagctgaccagatttaaaagatgcttataagatatttctgagttagattcaaaaagattaggaaggcagagttcatgtttactttattagcatattttaccaacatgtggtacagtttatggtgatcagtagatgtttttcagaatgaatgaatgaatatctgttattgtgttgtcagaatttcctctcatccctttgaagtttttactttttgtagtttccttttcagggtatacctttatgctgaactctctgggtacgtttcggtcagtcttaaatatataattaactaggtccaatcattttttttaaaaaaaagtattattaattataaaatgtatggtcacagccaggcgcagtggctcacacctgtaatcccagcactttgggaggctgaggcaggtggatcacttgaagtcagaagctcgagaccagcctgaataacatggtgaaaccccgtctctattaaaaatacaaaaaaaaattagccaggcatggtggcgtgcacctgtaatcccagctactcaggaggctgaggcaggagaatcacttgaacttgggaggcggaggttgcagtgagctgagatcatgccactgtactccagcctgggtgagagagcaagactgtgtctcacaaaaaaaaaaaaaataaaaaataaagtatagtcaactttctttttcactttgatttatagctagttcttgcctgttggttgacctaagtccatggtagcatttctgaaagaagaagtggttgctacaacaatttaagcatctgtgagatgtttgggtttagcaaatgaacgtaatagcagtggtcattgtagtaaatgtgcatcagaaatgcatcgcactgatctatcgtgtgcctctaccatagtagcatttcacttttctccttttaaccctactcaaatatgtactgtcatccttataatatggcaaggaactaccatgttgaatacctactatttgctagatgtagtagtatgcattttatatacattaccacattgaattcttcttatcagctacattttactcataaggaatgtgactttcaaaagaataaatgtgttcataatcatagtcgagtagtggctgaactgggatttttggctcgggttattgttccccaaagacaggcttgctttttttttttttttttgctattatgtgtgtgtgtgtgtgtgtattacagtatacatatatacatatacatatgtattagtacatatttcaccattagttcatatctccagaaatatttattttgccatactcgattttatttgaatatttcccaccttcaacaactttttttccttttattctaggttttatcatataaatttacttataatacacacaactcattgtgtaatatttgtgtgtgcgtgtgtgtgtgtgtgtgtgtgtgtgtgtgtgtgtgtgtgtgatggagtctcgctctgtcgcccaggctggagtgcagtggtgtgatcatgactcaactgcagccttgacctcccaggctcaagcaattctcctgcctcagcctcccaaatagctgggattacaagcgcctaccatgacgcctggctaattttttgtatttttggtcgagacagggtttcaccatgttggccaggctggccttgaactcctgacctcaagtgatcctcctgccttggcctcccaaagtgctgggattacaacacccagccctgtttaataacgtatagatttcaagtactttgaggcagtttttataaaagtaaagaaaataaatttatacattattgatttctgtttctcaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgtaagtacctttttgggtttgaaattctgtgtaccccaaaaaaccagaccagcttaaaatcataaatagtcacttttttttatttttttgagacggagtcttgctctgttgcccaggctggagtgcagtggcgtgatctcagctcgcaccactgcagcctccacctcccgggttcaagcaattcctgcctcagcctcctgagtagctgggattagaggcatgcaccaccacaatcggctaatttttttatatttttagtagagatggggtttcttcatattggccaggctggtctcaaactgccgacctcaagtgatccacctgccttggcctcgcaaagtgctgggattatacgcatgatccactgcacccagcccataaatagtaactttaaatactttatgagtacattaaaaatactttcatgtatttgtgggctttataaacatgtgaattgttatataataggtacagtgacaatgaaaattaggcacaaaattagaaggaggtttatactggggtgaaatcattttccgttatgcagttctgatatttagagtcattcatttggaggtggtgaaaaagatgtatggtctaggaaaggaagacctctgcatttttctgtcttttggtaagtaccttaaggcagtagtttaaagttttagtttgaagctcagaataccatggggttaaaaaaaataaagttttaacggtggaacttttaaaaataaaagtttatgcagaatgccatgtttaacaaacaaaaaagttttttttctttcttttatcacatgatttatttttccatgtctatgtgtttggcccacactttaaaaataattagtcttgaccgggtgcagtggctcacgcctataatcccagcactttgggaggccaaggcaggcagatcacgtggtcaggagatcgagaccatcctggctaacacggtgaaaccccgtctccactaaaaaatacaaaaaagttagccgggcgtagtggtgggcgcctgtagtcccagctactccggaggctgaggcaggagaatggcgtgaacctgggaggcagagcttgcagtgagccgagatcacgccactgcactccagcctgggcgacagagcgagacttcttctcaaaaaaaaaaaaaaaaaaaagtaacaataataataataataataattagtcttggccaggtgcagtggctcatgcctgtaatctcagctgttttgggaacctgagacaggaggattgcttgaggccaagaatttgagaccagcctgggtaacagagcaagacccagtctctacaaaaaaatttaaaatttagctgggcatgatggcacatgcctgtaatcccagctgctggggaggctgaagtgagagatttgcttgagccaggaatttgagactatagtgagccatgatcgtgccactgcactccagcctgggcaaaagagcaagacctcggctcaaaaaaaagatacttagcctttgtcttatttatcttgtacctcctaacttcctccacaaaataactacatcgtgagtaaataagagtgacactcagacacaggtggttgagtatttaaagttaggaacagatttagcttttctcattatattccaaaagaatgagttttaaatgataatcgaaagtgttttagttggcaattactttttttcttttggatatatgtttagtttaacaatgtttataataactcctactgggaatactatcataagtagtcagaactttatgtttttcaaagtactgttctattttatttgacccttataacaatcctgagggatagaatgggcaaatattgtcatctctactttacttgtaaggagattgactttttttttttttttttaaatatagatgggggtcttgctatgttgttcaggttggtcttgaactcctgggcttaagcagtcttccttctcagccccccaaagtgctaagattacaggcttgagccactgtgcctagctggaaattaacatcttaatcaagttagttatagagcttaatcttgaatgtggcttcttttctaccacgttataattggattttgtctctagtggtatgaagaataaaaacctaataaatgctggcagctaatattatctttgtctttttgtgtcccatcagttttcattcctcaggaattaatttttatgggtctcttttcactggattagtgctgatatgacagaaaatgtctattttaatactaaagggtcagatggaagagtgaatcccttttttatctatctctgtatctactataattttttttagcattaagtaaaatataaacttttgagggaaagactatctaaaatcagagcatagtactctgcaaatattaaagaagtgaatgacttaaaaatgatcttaagttactccttttgcccctcatcctatgttttcaaaaagctcgcatttctggaaggcctaatatgtgccaggagcattttacagaaatcatctaatttaaccctaagaccctgatgagctgggtattagcagaccaaatgtgtgataacgggcaaattacttaactgctctatgcctctgtttcctcatttgtaaaatgaggatgatgatagtacctatctaataaggatattaggttattacatttcaagtgcttagaagagtgcctagaatataatgtgcccaatacatgttagttgttattattgtccttttcattcctaagccagggtcattcatctggcatgttgtaaaagggaaaaacagtttttcctctctaatctttttttttttttttttgagacagagtcttgctctgtcatccaggctggagtgtaatggtgcagtcctggctcactgcaacctctacctcccgggttcaagcgattctcctgcctcagcctcccgagtagctaggattagagatgtgcaccaccacgcctggctaatttttgtacttttggtagaaacggggtttcgccatgttggccaggctggtctcgaaatcctgacgttaggtgatccacccaccttgacttcccaaagttctgggattataggcatgagccaccgcgcctgacccctctctaatcttcacactcaacacagaacatttctgtgacaacgtatgtgaggattttttccccatacaccaaagtaattctcctgtgtacaccaactaggtgtcctataatttagctcaattttgacattatttacctctaaatagtgtcagatctcacagattaaggactcagtcccaacacgactgtctcacacttcaggcgccaattgaaagtcccaggttgtgaactgtgctccgaactgatcagttataaattggagttcccatgaccccctccttgggttccattaatttggtcgaacagctcacagaaatcagggaaacacgtttaccagtttattatgaaggactttaaaatgatacagatgaagagatggacagggcaaagtataggggcacagagtttccaagccctctctgggcaagccaccctcctagcacctccacaaggtctgcaaccaggaagctcatcaagagtttttatggagcttgatctctagcctctcacccctgccctttttttttttttttttttttttttggagacagggtctggctctgttgcccaggcttaagtgcagtggcaccatcttggctcaccataacctctgcttcctgggctcaagcagatcctccagcttcagcctcctgagtagctgggactacaggcacataccaccccacccgactaattttgcattttttgtagagatggggttttgccatgtttcccaggctctttccccaattttttagaggtcagtgggtggggctgaaagttgcaaccctctgatcctttttctttttctcatgagtcagtttggtttcaagtaacccttcaatcctctaatcatctggtctttttggtgactggccctatcatgaggttatctaggggccctactgtaagtaacctcattagcataaactcagtatttatcaaaggtactcattatgaataacaaaagacattattatcactcaggatattcttagcgttttaggggctctaagacaggaaccagggacaaagaccaaaaatatgtttcatattataccacatgtggtggagccaggatccaagctcaggtctgtcaggttccaaagcccgtgatgtttccattataagatgccagagtgaataatagttggccataaccgggatggtcagtcatatgatgtgtttgtgttcagagggcttgaacctgtcttatcctagatatatggctatctgccacatatgatgttttagtcagtgataagactataaatacccatatatatgacagtaatcctgtaagattatactatatttttactgtaccttttctctatatagatatgtttagatacacaaatacttaacattgtgttacagttacctacagtattccatacagtaacatgctgtacaggtttgtagcccaggagcaacaggctatacctatatggcctaaatgttgtagtatatcatctagccgtgatatttgcacaatgacaaaatcgcctaacagcgcatttctcagaacatacccgtctttaagcagtgaatggctgtaattcacagacgggagcttggatgaaatctgtaattccttctcagatccaggagatgggccctaaattgtgaaaccagattgtaacaggattaggagttatcttcattctcatcccagctcttaccattaatctataagactatatagcctaagctataagtaaaacctagggctctgtaagaccttgatcaagtcttttagcatctcagccagttttaaaacactcaaatgccagaattctttatgtaaaaagtagcttagaatcatccacagtaggaggttttagatttaaaaaaactatctagaatctatattttgtagtatttttattgtctgttatccaagagatttttaaaattctcttcctgttcatgattgatttttactgtcttggaatatattaatttgagattcaatgaagatatacccttaactcttatattgtttctttttttttttgtacaagcaagtctctttatttccaaagtacgttgacctctccaacccaagttaaaagaatacacagtatgattccatcttttaatatattaacatcaagatgtacatgtttgaaaatggttggaattttatactggaataatgcatactaaactattaatagtttctacctctgagggtcatgggtgtaaggggggcatgaaagtaaacattcatattttactctctctgtcttgtgtttgaatcttttataatgggagtgcattcacatgtaataacttttatttttacaaagaatgagttttcccaagagcaaaatgcaaaaattctgctatagcttgttgacatttaatggaaatatattgctttatataatatatgaattgttcagaagtgataatagctttaatcatgctcccaataaaagatatgctagttaaagaaattctatagtttattccataaatttaaaaacatgtagaaaacgagtaccacccataaattaaatgatgtatttggtgcagggcaggtaagccccaaagttggggcttagctcgggacagttcttggctttgtctaagaaagaagtcaaaggcatgacaatggtaggaacctctgctgaagcggcagcgtacagcagcagcaaaagtactgtttcttgtggagcagggctattccataggcagtctgcctcgagtagcctatattgctctttatatttagtaattttttagcagaattctcaatctcacatttcttaaccttccttctcttttttcaggatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagtaagtttacaaaactacttatattctcattaaagccctaaatgctgtagtaagaaacttagagatgagtcttggcaacatagtgagaccccgtttccataaaaaagtaaaataattatccaggcatggtagtgcccatctgtggtcccagtgactcaggaggctgaggtaggaagcctgggagatcaagcccatgattgtgtcactgcactccatcctgggcgacagagtgagaccctgtctccaaaaaacaaaatttttttgtaagatattctttatgaaaattagaagataccactggccattataaaaagatatttaagatttaactgataacaaactaaaatcacattgcctatatagtgacactttctttatagtgtgtttatggcaatatttatagtgaaagtttatatactagagtagtatataaactagagtagtaacatttaggttttttttttttttttagtggtaagtatattcaagatgaaggaagatacattttattgaccatagctctttaccttctatggattttaaacttaaagttggaaagaagctttatattattttaatgttttccaaagtaaaaatcattttatcttttaaatgactataaaaataatgtagctcattgtaaaaatattcagaaaaatagatatataaattagatgaaagtcactttattttataacacccagagataacttatccttatatatttctgtgcatacatacgaatgtatgtgtgtttgcaaaaataggatcccactattttataacttactgtttttactctgtatatcataaacattgtccatgttaatgtatatacttcaacacaatttttaagtataaataatgtgatgttatatggagacaccataacatattttaactatctattatccataggttgtagagttttttcctttttttttttgttattgtaaacaacactgcaacaaacatatttgcactatgccttgatattctaatcatttttttttttgacatggagtctccctctgtcacccattctagagtgcaatggcacgatctcgtcttactgcaacctctgcctctcaggttcaagccattctcctgcctcagcctcctgagtagctgggattacaggcgcctgccaccacgcccagctaattttttgtatttttagtagagacggtgttcctctctgttggctaggctggcctcgaactcctgacctcatgatccgtccgcctcggcctcccaaagtgctgggattataggcatgagccaccgcgcccagtcatatattctaatcatttttaaggatatattcctggaagtggaattgtagtgctaaagactagatacatttttagaacttggaaacactttgccacgttcacttccagctaagttccagtgtatgtaagcttccttctttcttcaccctttcccttcactaactcggtattaccttattctttttctttttaattctttttttcaaaatttgttttgttttcatatcggttctgcagatatcccattaatttttgccagtctaatgggaaaagaaatctttcttcttctcttctcttttttcttttcatttctttcttttcttttgagacagggtttcactctgttgctcgagctggaatatagtggcacaatcatagctcactgtaacctcgaactcctgggatcaagtgataataatctgtaccatattggtagaaaatatattcttttaaacctaatgctttttctctttttaaaaaaataggagcaagcatttgatccttatgaaacattatcacaggacattctttcaccagagtttcatgaacatttcaataaattgatggccagacctgcagttgctctacactttcaggtaaacttaaattgaaggttttttttttttttttttttaataaagcaaataaatatctcactattttatccttcaaatatttgtaattctggaatcctcgtaatccttcaaatcttgttcattctaaacctgttttggattatcttctgttttctctctggagttctgtctgttcttattgtagaaatcttttatagtacaacatcatgagtactgaatgaccagaagaatttggcacatactagatctggggtataaagatgaatttggctgggtgcagtgactcatgcctagaatcccagcattttgggaggccaagacaggtggatcacttgaggtcaggagtttgagaccagcctggccaacatggtgaaaccctgtctcgactaaaattgcacaagttagctgggcgtggtggtgagctcctgtaatcccagctactcaggaggctaaggcaggagaatcacttgacccggaaggcggaggttgcagtgagccgagatcgcgccactgcactccagcttgggtggaatagtgagactctgtctcaaaaaataaatagaaaaataaataaaaaataaagatgaatctggagtgtgatttcaggattatgttccctataggaggaagatttggagaaatcttaaaaagttgagataacctcaacctcctatgtactcatactgatttttctatgaggcctacaatttaaaggagataaatactgtattgagggagagtatgcaagttagttggttcaggaatacacttagataaaatgaaaataagtggagagatacaaataaaattttatttttactatctcaacactaacaacaaaagttatgttggcataggtaatacttggctaaatatgtaaaacttctacatctaaactgacttttccagccagacgtggtggctcttgcctataatcccagcactttgggaggctaaggtcagaggattgcttggacccaggtgtttgagaccagcctgggcaaaatagggagacctcatctctacaaaatataaaaacttagccgagtgtggtggcgtgcacctgtggcatgccaggagaattgcttgagcctgggaggtcaaggctgcaatgagtcatgatcacgccactgcactccagccttgggtacagagtgagacccagtctcaaaaaaaataaaaataaaaaataaactggcttttaccccttgacgtttgaatatggtaaaaatccttatagtcctgaaacaaacaagcaaacaaatgaacaaacctttcttcactctagtagaataattaactagagtgaagaaagttttttcatttcctctctcattttttctttgcagccaattgtctttatattattttttaccattctttatgaaaacactaccatgtatgttttaatcaggatataaattgcctttgacaagtaacttaattgccaaatccagtggatatttttatttcatacttaatgtctgtagtatttgttactgctcttatctcttggttcctgtatacctgaaggctgggcgtgatgtctcatgcctgtaatcccagcactttgggaggctgaggtgggtggatcggatcacctgaggtcaggagttccagaccagccttgccagcctggcgaaaccctgtctctactaaaaaatgcaaaaattagctgggtgtggtggcatgcacctgtaatcccagctactcgggaggctgaggcaggagaattgcttgaacccgggaggcggaggttgcagtgagccgagatcgtgccactacactccagcctaggtgacagagcaagaccctgtctccaaaaaatatatatatatatatgtgtgtgtatatgtgtgtatatatatatatatatatatatatatatatatatatatatgcacacacacacacacacacacactagcgggcatggtggtgcacacctgtagttctagctactacagaggcagaggcaggaggatcacttggaggcaggaggatcacttgaacccaggaggtgggggttgcagtgagccgagattgcaacactgcactcaagcctgggctacagagtgagactctgtctcaacaaaaaaaagaaaaagaagactgagactgggtgatttataaagaaaagagatttaattggctcagagttccacaggctctacaggaagcacggctggggaggcctcaggaaacttacgatcatggcggaagccaaaagggaagcaggcacgtcttcacatggtcaaagcaagaggaaggagcagggaggtgccacacacttttaaacaactagatctcctgagaactctattacaagaacagcattaaaggaagaaatccacccccatgatccagttacctcccactaggccccacctccaaaattggggattacagttgaacatgagatttggacggggacacaaaatcaaaccatatcagctcctgtgatactacatgttcccaattttcgtcttctctgatttcttcttctaagtctcttaattattatagctattatccaacttctgttatcagcccctgtttttctgttctgtgctctccttgggtgacttcatgtctatatactggtgacttcttatttgtatttccaggccatcactttcttttaagcactgtgtaccgtgtacatatgtgtatgtatctatacactttcatataaccagctgccttgaattgatgcacttggataccctaaacgcacttcaaatatgacatgtttaaaactgaacttaccatcttctccctgccttctgtactataaattcccattgtttattatcttccacttctctattgtcaaaaatttgttatcatggaatacaaattatacttaattctcaaaattacttcaagagaggaatatttttaaagttaactcatatattcatataaagtatgcattaaatacacagtctataagaactttggatactcattaaaagcactcaacacatttcttgtttcagtcctattttattaggaatttttgctgtggaatttgaatgttaaagggcccagttattaataaagctgtcatcctagatattcagtgaaattggaagagttagatgaaatcctttttcgggccaaactcaattgttttaacttaaaaaaaaattcattcagtttaagataaaataatgcttccttaataaaactaaaaacaaaaagcatctttagaagctgtgtagcgtactttatttatttatttatttagagacagggtctcactctgttgcccaggctggagtgcagtggcacagtctcagttcattgcaacctccgcctcccgggttaaagcgattctcctgccttagcctcttgagtgactgagactacaagtgtggaccaccacgcctggctaattttggtatttttttggtagagacagagtttcaccatattggctaggctgttctgttgaccatgaggcaccatacctggactgtgtagcagacttaaaaaaataagatttgaagttagaacttaaggctttgggccaattaatagttttgtttgtttgtttgcggcggaatctcgctctttcacccaggctggagtgcagtggcgcgatcttggctcactgcaacctctgcctcttgggtttaaggagtcctcctgcctcagcctcctaagtagctgggactacaggcgcatgccaccacacctggctaatttttgtatttttagtagagatggggtttccccatgttggccaggctgttctcaaactcttgacttcaggtaatcctcctgactcagcctcccaaagtgctgggattacaggcgtgagccatcacgcccagccccagttaatggttgtgttaccttgagcaattcacttaatctctgagactcagtttgctcatttgtaaaatggtgatcatcataatatatacctcttatagttattaggaaattaaatggtaatgtatatataaagcataagcataatgtttgatgtgtattaaatactcaaatgtagctcctgttattatcagaggactccttacactgtaaatacatgctacaaaaattttagaatgcactttatcaggcattttagtacaaataagcaaaacagttgatcttgtagactaattttgaagtttcatattggttccagttcaagcactgtatataaaatatccagaataattcactatattaattagtttaatactgtcttagtctattcaggctgctctaataaaatatcataaactggatggcttataaacaatagaaatttatttctcacagttcacatttaggaagtcccatatcaagaggctaacagatttggtgtctagtttggtgccctagtgagggtttgctcttctggttcatagatggtgctttcttgttgtgtcctcacatgatggatagcacaaacaagctcccttaggccccttttataagggcactaaccccgttcacaggggctctgccctcatatccaatcacctcctaaaggccccatctcttaatactgttgcattggggattaggtttcaatatatgacttttgagggaacacaaacattcagatcataacaaatgtgaaaatgaattaatctttaggaaaattggtggcactttttgtgtatcctagtaagaagtttggttactggataataagtctgttgaaaagattataatttaacaaaatgtgaaaattatggtaatatttatgaagatttttttaaagcagcatatcagattctttctcacattttatattggtgtggttggtgtttttcttatggggagaaatactagtaagtgaactatatagacatttaaaattaacatgagttaaatccattataaattttagaaaaccatttattctacagtagtttccaaaactggggtatacctatcccaagctatacactaagatttttcaggatatataaaggcacagagagctttaagggaatctgtttctagtcttcggagatcttgtttatgttttttgcattgtcttttccaaagtctcttacttgttaccttttgctgttatgtatttcccattatgcattgatccaagatgtaaaaacctctagggcaccaaacaggaaaaaaaaaaaaaaaaaaaaaagtattactcctattggagagttcactgagtaccaagcaaaagagttcacaaaagaatgttatagggggatgatagtaaaaattcttggtagccaaaatgtcatctatctatgttatgtcatatctatctgtctaagaattaagaagtgatatggttatcacaaagatttatgttaaccttattgtaagtacttcatcatcatttgggataaagaagaggagaagcttgtaaagttctcataccttgatgtaatatgtcagaagcagttgtagtttcctccagaggcttctaatccttgagaccatgacattaataatgtttgtttgaatttaacaataaagtttgacttctgacaaactgagctgatgttgctgtttattttgacagtgaagatcgactttgtcaattaagttgtatgacagacgtttttcataaatgagctaaatctgaaagttattcaattattgtttagtgaaatagttataaatcacatttacagtatacagcattccctgaaatgcatcttttgtaactatttaaatttaaaacattttaaaattgtgcaggagagtacatagcttttcagaattcctttagggtatatggaagccagaacataagctgtagaggattattgtgaaagctattttagccacataaaagaaaattaatgtatatatttctctaataacttaaaggaggaaagggagaaaagaacaacttgatagcacttcagtttcaatatagaatatgcattctgttgtagttttgataagtctgtatctcaaatttttagtagacgtttctgttaggcactgctgttgcatatccttgatgtcagagacatacatactgtgatatctttttgctttgcagtccattgctgatggttttaaagaggcagttcgttatgtccttccacgtcttatgctggtgccagtgtatcactgttggcactactttgagttactaaaggtaaggttttataacagaatctcaaagtacttatctaatagaagagtttactttttaaaattaattttggagacacacagtaccagtcttttaattcttattttatgtaagtatttaataatttttatatgtaacattgctctaaatttctatcttgttatcttataaaggaaataacttttgaagttaatatttttttctgtgcagtgttgtattcttcctctcttagctgggacccaagcaacacattaaaaatatatatataacttaaaaaaaatgactctcttctctattttaattaactagccaaccactagtcctggtcacattggctaagagggtttggaggctagtgattaattggtggcaaaagtagctgtggcttaggatgagtcaggccattatagtcaatgacctgatcttaaatgcagacctagtagcaaggatttttaaaaagcaatcatctaggtaggggaaaattttttttaaattatatggtcaaaccagcatttttaaatgttggccaatattagagggcaactctaagactaatgataggacctctaataagacatgaaccttatttttaaaaattaaggcatccaaatatatgcttatatattattcatatgaagccagcatatcttttgatgagttctttatggatccactagtatccatggagacttacacaatgaagttgctcatctatttgtggataaaagctgactactgccgggcgcggtggttcacgcctgtaatcccagcactttgggaggccgaggcgggtggatcatgaggtcaggagattgagaccatcctggctaacatggtgaaaccccgtctctactaaatgtacaaaaaattagccgggcatgatggcaggcgcctgtagtcccagctacttgggaggctgaggcaggagaatggtgtgaacccgggagacggagcttgcagtgagcagagattgtgccactgcactccagcctgggcgacagagcgagactccgtctcaaaaaaataaaaaaaaaagctggctacctccagcatcaaatgctgtgggtagtagcactccataaaaaagaacttaaaaaagagataagtattcattagaaataatcatatatattccttgcctagatgcctacaaggtatacatagaattattatggcttttattttaatgttactaccatggattagacggaaaaagtcgtaactgtctatctaaaccaacgatgtggtatcctaaaggagaggtacgaaataatcaagcagaaagatactttgcttctaaagagcagttaaaaagttggaagctgggcatggtggccacaagcctatagtcccacctacttgggaggctgagataggaggatcacatgaggtcaggagttcaaggccagcctgagcaacatagcaagaccctgttaaagaaaaaaaaattgagaaagaacattttactgagcaagatatgtgggaattacagttgaaaatgggccataatctgaaagtagacagaagttcttagatgttagctagagtcagtgaaaatcagtagcagtaatagagagaaatgaatggattgtcaccagaaaatctccatctttcacgtgctcactttggtaatcactcctgcctttaaaagatcaagggaaattgtgtaaggaattagaaatgggaaaagaaacactcactgatgagtactcatgcttgtccaaaggcagcagatactctttattactaggtagtagtaattttgggcttcaaagaatgaataaagagagccaggtgcggtggctcatgcctgtaatcccagcactttaggagtccaagggggagggaatgacttgaggctaggagtttgagaccagtctggccaacatggcaaaatcatgtttttagtctctactaaaaatacaaaaattagctaggggtggtggcacatgcctgtaatcccagctactcaggaggctgaggcaggagacagcttggacaacagagcgagactccatctcagaaaaaaaaaaaaaaggaatgaataaagagaaactacccatgtctgatcaatgaaactgtaaccgttagaataaatatggaatatactcagttttaattaatgcacagcaacaacaagaacaaatagaaatgtggaatggaaagacaagccttagaagagattagaaatggcaaaagatttgaatcacttcacaaaacaggatatccaaaatggcagtaaatgtgtattcaaaccattaatagtcaaggaaatgcagttaaaaccacaggataccactacatacacatcagattacagaaatttgaaagtctgaaaatatccataaacagcagcatgaactatttgcattctgttaggaatgtaaactgtataacccactttggaaaactgcttggcattaccttttaaattaaaaaatatgtatactgtctgactaggcaattccacccttgaatatatactctaaagaaacaaaatgcaggcacatgtataccaagagaaatgtacaagaaagtctgtagcaggtgtcagtaatagcaaatcctgtttgccaaccagaaaagggtaaataaattgtggttcattcagataatgaaagaaacttacactagaacaatacacaacatcaatgacgcttacaaataaactttgagagatgataatatttcattggtgtgttataccatattttatttatccattcatctgttgatagaccgttgaatttttttttttttttttttttttttttgagatggaattttgctctgtcgcctggctggagtgcggtggcatgatctcggctcactgccacctctgccccctgggttcaagcagttcttctgcctcagcctcctgagtagctgggactacaggtgcatgtcaccatgcccagctaatttttgtatttttagtatagacagggtttcaccatgttggccaggatggactcaatctcttgacctcatgatctgtccatcttggcctcccgagatgctgggattacaggggtgagccaccgcgcctggctgactgttggatttttttctaccttttggttactataaataatgcttctgtgaatgtgagtgtacaaatatgtctttgagaccttgctttgaattattttatgtatatacccaggagtggaatggatggatcgtatggtaatgttatctttaattttttgagtaactaccacactgtttttcatagtaatggcaccattgtacattcctaccaacagtgcacagggttctgatttctccacatctttaccaaaccgtgttaatttctttttctttttcttttttttttttgagatggagtttcactcttgttgccctggctggagtgcaatggcacgatcttggctcactgcaacctccgcctcccaggttcaagcgattctcctgcctcagcttcccgagtagctgggattacaggcgcctgtcaccacacccagctaattttttgtatttttagtagagacagggtttcactatgttggccaggctggtctcgaattcctgacctcaagcgatccacctgcctcatcctcccaaagtgctgggattataggcgtgagccaccctgcctggcctgtttttttttttttttttaataatagtcatcctaatggatacgaggtggtatctcattgtggttttgattttaattttcctaatgactagtaatgttgagtatcttttatatacttgttaactatttgtatatcatctattttattgtgttgtttttgggacagggtcttgctctgttacccaggctggaatgcagtgatacaatcatggcttactgcagccttgacctcctgggctcaggcgaccctcccacgtagctaggactacggatgtgtgctaccatgcccagctaatttttaaattttttgtagagatagagtctcaccatgttgcctaggctggtcttgaactcctaggctcaagcaatctgcctgcctcagttttccaaagtcctgggattacaggcatgagccaccatacctggctatattttttttctttggatataagaattatgttataaagttacttataaatcaagaagtgattttttttcttttccttcttgcatgaagattgaattatatgttaagataataatctaaaattatgtttaaaaagcagtttgtagaaatttatctaaaatttatcttagaaagtggggtaaggtgcctcatgcttataatctcagcgctttgggaggccaaggtgagaaggtcacttgagcccaggagttcaagaccagcctgggcaacaaagtgagaccttgtctctacaaaaaaaaaaaaaaaatcagattagctggacatagtggtgcatgcctgtggtcccggctactagggaggctgaggcaggaggattgcttgagtccaggaggtcaaggctgcagtgagccatgtttacgtcagtacactccagcctagatgacagagtgaaactctgtcttaaaagtaaattaataaataaacaaaatttatctgagaagaaaaatgaaaacagtagtttgtgatcaaccttatggggcttaaatttgaaaagaacaaaaaagtattatctataaagtgaatatattatagatatatattctatatatctgccatgagttaactatatatatgtaacaatatatattgccatgcaatataaattgttgcatggcaacaataatataacattattccaacaatgtatataacaatatatattgccatgagtaacaataaaccaacaatgtactttgtttgttttttgaggcacggtctcactctgtcacccaggctggagtgcagtggtgcaatcttggctcactgcaacctctgcctcccaggttcaagtgattctcctgcctcagcctcccaagtagctgagattacaggtgaccgccaccacacccagctgatttttctatttttttttagtagagatggggtttcaccatgttggccaggctggtctcaaactcctgacctcaagtgatccacctgccttcggcctcccaaagtgctgggattgcaggtgtgagccactgtgcctggcctgtttgtttgttttttatttttatttttattttttttgagatggagtcccactctgtcgcccaggctggagtgcaatggtgcaggctcggcttactgcaacctccacctcccaggtttaaacgattctcttgcttcagcctcctgagtagctgagattacagatgcgtgctaccatgcctggctaattttttttaatatttttagtagagacggggtttcaccatgttggtcaggctagtctcaaactcctgacctcaaatgatccgcctgccttggcctcccaaactgctgggattacaggcgtgagccactgcaccaggcctaacaatgtactttgaaataattttaggtaactatatatggtatcctctaatttcttgtcatatagttgtttttccatcttgttttatcataaatctgattttggaaaataaaaaataatatttaaacactaaatccaagaataaatctctcttggtagatcaccaaagcagatactttaaaacagtgggttaaaactgttccaggattgtgttttctactactaaagggatgtaataacctttgagtcacactagtccagccttctttcttatgattctcatcccaaagtaggcttaacatgagacagaatttattttggatgagtactgagccaaaacagtatcacgaaacggcattctatagaatgggaaaatatttgtaaattatatatctgataaaagattcttatccagaatacataaagaactcctacaactcaacaacaaaaaacaagctgactaaaaaaatgagcaaaggatttagacatttctctaagaaggtatataggcgaggcacagtggctcatgtctgtaatcccagcactttgggaggctgaggtgaaaggatggcgtgaacccaggagtttgagaccagcctgggcaatatagtgagacctcatctctacaaaaatttttaaaattagctgagcgtggtaatgcatgccagtagtcacagctacttgtgagactgagatgagaggatcacttgagcccaggaattagaggctgtaataaactgagatcacaccacggcactccagcctgggcaagagagcaagaccttatctcagaaaataatctatgtctgtccttttttactaaggacatgttaactctctcattttagaactggtttattcaaaggcaagtaatgttctcttactctcctaactccctggtcattccttggaaatttagtaatggaaagaataaaaattattctctctcaagaggaattaatttagtttaaagcttaacaggaaaacttagtaataacttcaatgaggttcattgaggaagatcaaccagtatttcaatatgaaacaattgagtttataggtaatatttttttaccttttactttgaaaaacagaaaaaagttacagaaatagtggtgagcacccttcacctggactcactttttttttcttttttttttttgagacagagtctcactgtatcgcccaggctggagtgcagtggtgatctcggctcactacaacccccacctcctgggttcaagcaattctcccacatcagcctcccaagtagctgggattacaggtgcacaccaccacgccattctaatttttgtattgtttgatagagactgggtttcatcatgttggccaggctggtctcaaactcctgatttcaggtgatcctcctgcctcagcctcccaaagtgctgggattacaggtgtgagtcattgcgcctggctaccagttgttaacattatgcaacatttgcttgttatcattcctgttttttttagacagagtctcactcttgtcgcccaggctggagtgcagtggcccattcatggcttactgcagccttgacttcccaggctcaatcaatcctcccatctcagcttcccgagtagctagaactacaagagcatgccaccatacccagctaatttttgtttttttattttttgtagagaaggggttttgtcatgttgcccaggcttgctttgtcattctttttgtgtgtgtgtgagtatattcataacataaagagcttgcaatctctattgaaagaaatctctcaactcttaaaaaagaccataaagaggattttactacatatttactttttcagtactgacatatgattcaggtacatatgaaagaaagttaataacagttaactttcttatgtgtttttttttaaagttagtgttttttttaaaaaagcacgtaaagaaatatgatcacgggttttttgtttgttttggggtttttaggttatttctttttagagagggagtctcgctatgttgcccaagctgatctcaaacttctggcctcaagtgatcctcctgccttgaccttccaaagtggagagattacaggcatgagcccgtgtgcccagcctagtcataggttttaatggatttaatttcccaccaaattaccaactccactcttatgaaaatctagagagtttattactaataaaaaagaattgattacatgttttatttcacacctagactgaactcctagtacagtgaattagagacaaattcataatttattgaaattccccttgctgtgggcacatatgtccatagtagatgtagcatttggtaggagtttcaagaaaagcagggtaaatatttcagtgaattctcatacagagttaagaaaaaacttacatgaaatataaaatcttagacaggatacacttatagacaactaaggataatgatgagtatcaggtagcaaggaatatattcttcagctaggttcataagatattacccattaaagctaggcgcggtgggtcatgcttgtaatcctagcactttaggaggccaaggaaggtggattgctggagctcaggaatttgagaccagcctgggcaacatggccaaaccccatctctacaaaaaattcaaaaattagctggatgtggtggcaatgcctgtagtccaagctactcaggggttggggggttaaggcaggaggatcgcttgaacccgggacatcgaggatgcagtgagccgagatcgtgccactgcattccagcctagttgacaaagtgagactttatctcaaagaaaaagaaaagatattacccattaataaacaatcacttttatttttaattttaagcatatgtagcaagggtatcttttctctttgacctcttttccagagtacactcatttcattttatttcttaaactcagtagttatccagtttgttttcaacatagaaagaatccctttcaactcagtggtcatcagatttagacacagaccagtgttttgcgtagctgtgtctggtgtcatggtagagccacggggtattagtgtagcaaaaaagcagagactttggggtcagagctcctgggtttggatataaactctcctatttatattgggcaaattacttaatttctctgtgcctcatttccttcatctgtaacatatgattatagtacctcgtgttacagagttgtaataaaaattaaataagctaatgcataaaagagcgtgcacagagcagagctcaaaaaacattcattattggtctaaatacttaacaaaatcatacagtagtcatttattccagttacttctgacaaccacctagtggatacctaccacatgcaggtaaactgaaaaggaataaaacgtgtccctaggcattaagatgtttacaatttagtgaagaaaatagatgtcaaacaaataattacaatattataagagcctaatagaggtagtactatgagatcaatgaagcaggagttactagctctgcttagggaaggcagaaaaaaattcctattgatttttcctttgttcagtggagtaaaaaaaaatacataatggttttgggtattcgtcctactgagagagagaacagtgtgtgcgcgggtgtgtgtgtccttatttatttgcgggagtcatgaaagacaaatgcttaggaactctccagaataaaagagacaatagaaacatgacaatttagtgcttcactgaccagttcctgttttgggggaaaatattaccttaaaggatgttattaaaacagttggcaaaattggaatatacactatagattagattatgcagtagattactcggtgttaaatttcctgaagttgatcactatactgtgattctgtaaaagaaaatccttgttgtaagatgagctatgagaaatattaaaggagtaaaggagaatgatactatttgagagtaatttgtgatacatttgacttttccttatattccaaaaactactgcaaaaccattcagccgtagtcccccttcctctggaaggaactgagtggatagtatcacaactactaaaaaaacgatctgcacacactggcacacagaatgatgaagcatgtgacaaaatgttaaaaattggtgattcagagtattacaggagttatttgtgttacttttacaacttttctataaatttgatatttcaaaagaaaaaatttaagagggaaaaggcataatcagaaggcatcttcaagaggaagcatttcaactgtatcctagtggctaaattcaccgggtggataaggaggtcagagactgttgtgtagaaagcgaatgggggcatgaaagtacattacttgtttgcacatagttcagtacagtaatttttcttttctttttctttcttttttttttttggagacagaatctcgccttatcacccaggctggagtgcagtggtgctatcttggcttactgcaatctccacctcctaggttcaagtgattctcatgcctcagcctcctgagtagctgggattacaggcatgcaccaccacgtccagctaatttttttttgtattttttatttttattttcatttttttgcgggggacagagtctcactctgtcacccagactggagtgtaatggcacaatctcagctcactgtattctctacctcccatgcttaggtcatcctctcacctcagcctcccaaatagctgggactacatgtgcacatcaccacgcccggctaatttttgtattttttgtagagacaaggtttctccgtgtggtcaggctggtcttgaactcctgggctcaagtgatctgcccgccttggcctcccagtatgttgggattacaagtgtgagccaccttgcctggcccagtaatttctgtgtaagatgtttggaacacattcttttaagtatctgtagaatattagttggatattcattaatatgatgtttatcaaatctcactgctgaaaattcaagaaatatttagcaaattatcagattattatgccaaacagagccgttgtttaatatacttccattaccaggaaatcccactctaaatatcctcaattttgttctcctttacagcttataattattacatggttatttaaaaatgacacgtggaagagtttgagcagccttaagaccaagtagacaatgaaaatcatacctttttggtaggatatcactactggtgataatttagatatttggataaacaaaaacaagaataaaacagttctaattaagtgtttgatgtcatcaacattcatatttattaaagaaatattttagagtggagctgagaagactttctgtaagaaatctttaaagcagcaaaataagtgattttgccagtaactttcacctgtagaagtcagaataaccaagcacagatcttttttcaaactttctatgatattttgactttgcttccatcctttctattgcttagtctagagattaaggtattacttctaataatagtcatttacattatttatgttgctaatctcttgatgacaagacctctacatgtgtcttgaaataaaatcaaatggctctgtgcttcatatagagactaatttctaagacataaataaaaggtaatggacaaagttgtcaaacaatagccagttagttctttgctgaggaaagggaaccattgctgaatgcttttgagattgctcttggaatataaggaaaattttaatttatcacaaaatctctaataagttaaagatcacaaaatagatttaagtttttaaaaattttctgaagtgatcataattccccatatccttgcataaatatatatttataaatacataatatatataatatctatatgatgttccactttgaactcttctttcaaaagattaaaacagtttgagggcagcctgggcagcatagtgagaccccatctctacagaaaaattaaaaaaaaaaattagccaagcatggtggcacacatctgtagttctagctacttgggaggctgagatggaaggatcacttgagtccaggaggttgaggcaaggctgcagtgagccatgatcacctcaccgtattccagtttgggtgacagagtgagaccctgtctcaaaaaaaaaaaaaaaaatcaaaacattggagcacaatacaatacaatctgaattatttattataagtaaatttgctttctttctgagagtgaaatacaagagaacattttggggcaaatgaaatagaaccagagttttagagattaataagtcagtttctaaatcttctaaagattgagatagaattaattttcatggtttcttgacatttcatattgtaaaaaatagcagtggaatcctttgagagatgctgtttacggaaaagtttatgatagattgaagtgttaaaagttagtacccttgattatgttatataacaaagatttgtaaacttgaaattgctaaaacaaagtaatcattagagaatatgaaatagtttatagttacttattttctctattcatagttgctaatgaataaaagtaagttgtaagcttcatgctttaggtgttttaaactttttaaatatgtttggaaaatgtggcctggcacagtggctcacacttgtaatttcaacactttgggaggcagagatgggaggatagcttgagtccaggagtttgggaccagcctagtgagaccctatctctacaaaaaataaaaataaaaaaattagctggatgtggtggcatgcaactgtggtcccagctactcgggaagccttatgcccaggagatcgaggctgcagttagccctgccactgtattccacccttggtgacggagtgagtaagaccctgtctcaaaaaaataaaaaataaaaataaaatgtccgaatggtttttacagttgcttttttttttcctgattactatgctcatgttagtttatatctgtattgtgtttatgtttatagaaagaaggttgggccaggactggtggctcatacctgtaatcccagcactttgggaggcagaggcagaaggatagcttgagcaggtgttcaagaccagcctgggagacatagcgagaccctgtctctacagaaattttaaaaattagctgggtgtggtggcattcgcctgtggtctcagctacttgagaggctgagagtggaggatcattagaacccaggagctcaaggccacagtgagtgagatcctgtttcaaaaaaaaaaaaaaaaaagaaagaaaaagggttggtttgagagggcagtaggtatatataaaattatagctgtttttattaagtatatataaaattaacttagagttgataatatttgttgctgctttttctattactagaaagttgggggaagaatcaaacaatgcagttttgatttttctttctgttttttcttagcaattgaaagcatgtagtgaagaacaagaagacagagaatgtttgaaccaagctattactgctctcatgaatctccaaggtagcatggaccgaatttacaagcagtattcacctagacgtcgacctgggtaattccaaagtgttgaaaacgtgaatgcctctgcttacttcgctgtctctgatgcctggttttcaaagaagtgtgatttattgtgatagttacattattgaaagttgtgcttgtcatacttttatatacttttatgttggtcttttactctcttttttccttttcctttcctttttttttttttgagaaggagtctctcttgcccaggctggagtgcagtggtgtaatctcagctcactgcaacctgcagccttagcctcctgcgttccaatgattctcctgccttcgcctcccaagtaactggaactacaggagcccaccaccatgcccagctaatttttgtatttttagtagagacggggttttaccgcgtcggccagactggtctcaaactcctgacctcagcctcccaaagtgctcggattacaggtgtgagccgctgcgcccagcctttttttcttttttttaagagacagggtctcactctgttgcccaggctggagtgcagtgatgtgatctcagctcacagcagcctcaacctcctgggctcaagcagtcctcctgcctcaaccctctggagtagctgggactcgagtagctgggtggcacatgccaacacacctgcctaatttttgtattttttgttgaaatagggttttgctatgttgcccaggctggtcttgaactcctgggctcaggtgatctgcctgctttggcctcccagagtgttgagattgcaggtctgagccactgcacctggccaacccagcctagtcttaagattagcattgttggctgggcacggtggctcacgcctataatcccagcacttcgggagtccaaggtgggcagatcgcctgaggtcaggagtttgagaccagcctggccaacatggtgaaaccccatctctactaaaaatacaaaaattagccaggcgtggtggcaggcacctgtaatcccagctactcgggaggctgaggcaggagaatcacttaaacctgggagggggaggttgcagtgagccaagatcgtgccattgcattccagcctgggggacaagagctccaaaaaaaaaaaaaaaaaaaaaaaaaaaaaaaaaagattagcattgttatattattaggatagacttaataaatgtttaaaaatataatctatgaaagaaatttaggattttttgtaattttagttcttatagagccagtagtacttctctttcataataatgaaattgagggctgtattatttagtggcaaagttagaactaaatgctgtgcgtaaaagctactgtttggttatttaatattttactcacttgatttgagatggtttatgcttgaaaccatttgggttgctagctgttgaataagctatattgtttgttttttctagagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcaggtatgtgaaactcattacaactgctgacctagggcctgggacccaaaagctttttaaggatgctcaaaaatatttgaggcttggggaaaaaatggattgcctccaaaatataaaaatactgcaaaaacaaaaggaataaataagagaaggaattaaaggtctaaaaatgtaatattgttaacttcattaattattgaataaatattcataaaatatgcatattcatgaattttttttttttgagacagagtcttgctctgttgcccaggctggagtgcagtggcgctatctctgctcactgcaagctccacctcctgggttcacgccattctcctgcctcagcctcccgagtagctgggactataggcgcccgcaacaatgcccggctaattttttttttctttatttttagtagagatggggtttcaccgtgttagccaggatggtttcgatctcctgacctcgtgatccgcccacctcggcctcccaaagtgctgagattataggcgtgagccacctcacccagccatattcatgaatttcaaatttgaaaacaatcctcgcttattaaggatataccatagtatattctctatgtcagtatttctctatgtatggcagggataccatggtatcctgccagtaccatgattgttaggaaaagccacaatctgaggagccaaagtaaaaagaaaaagggaggaaggcctccaaatatggtactttgagttaattaaactgaatacattaaacatgaaacctattttatgctctgccttttcagatcccaattttgttcgtacttttcttaccacatatcgttcattttgtaaaccacaggaattgctgagcttactgattgaacggtaagaaaaatatgtatttcagttatattgacattttgtgaaaaattaactgtattttgtaaagtgcctagtacctaataaatactcaagttaattattgaacatattttatttggcattaaattggcagtattactattctcttcaaatggagtactccctaaaatctgtttataaacacagatcttttcagctcttagaaatatttcaagtggtaatcagaaagactaatttagaggatgaaagcactatattttaatgaatattgttctgtgtaataaaatgatattttcttaaaagagacttttctacttaccactatttttttttttggaccgtagactactttgccaaatactttccacttttaaaacaaacttgttatgaaaactttcaaaacacatacaagagcagatacaagaatataataaacccatttattcatcaaccaccttcagtaattatcaactcattgtttcatctgtttccctacaaatttaaacaccccaccccatgattattttgaagtagatcctagacaacataattcatctataaatatttttctatgtatctctagaaaatacgggatcatttttaataatcagatatcattattaaacctaaaaaatcagcaattcctttattatgattaacttttaaaaattagtgttgggttgaatttgttttacctagtattatagtggcattttaaatgttttatagtttaaaatgtagaatctggactccagaatgatttttagttttacgttttaaaacttactaaaacttattattataccaaagcttattaactgtattatcaagatataattctagatctctatcactatgttgttttatcaaactaaatttaccagactgagtcagtgtaatgtgctatgaggatctacttagttgtttccatgtccagaataaggaaagcacacgttagacttatagtttagctgtatttcctatgtttgagcaaggttttttatctttatcttatccacttaggtaaattatttaaatattgttaaatattcggttttggccctctctttgaatttgtactcatttaaataaatttattagcctactttcattttaataatataaatattaaagacattgttagataagcaatttctgtcatgttctttaaattccttatgaattctttccttggctcttttccctggaccttttctgtattatcagtgctaaaagacaaaactttagtttttataaaagtaagaatacaaaacgtcagttttgtatagccaaaggacagttttttgtagtatatcatacctcaagggaagtttaacagtaatccacttttcgtggaagtggtaggaaagaaggttgcttgctgttttcctccttgtattttcattatgtatgaacggatttttctccttttgcttttcttcttaggtttgaaattccagagccagaacctactgacgcagacaaattggcaatagagaaaggcgagcagccaatcagtgcagaccttaaaagatttcgcaaggaatatgtccaaccagtacaacttaggtttggcttgaatattttttatatatatatatatacacatatatatacacacacacacacattttatgtgtcagttttcaatatatagttaacacaaaagctctcagcttttaattcaaatatagggaatatttttaacttcacagcagttaagttaaactaaaagagttctttctcagtgaagctattcttaaataccctgaagaaattcaaatatttaaatatcctatgtttgcatcacatatctctggcatgtgatatgttatgcttacgtatcaggatacctattttttattgtaagtaaaaattataaaatttcatgtgagctttcctgctgtcaaccttttttcacacttttttccttcatttccctttgcgatcatacagtaatcctggctttttttacaatttataatatttgtggaagttctagcccttttcccacttatctctcacaaaatatatagacatttgttagtttaattgcaataatttctaaaaatgtgtttgattgtagaagcttccagttaataaatactactgtgtgccggggattaccctaaatgctttatcttttttatctcattcttacaacatgattactattcctactttatatataaggaaattgaaacctagcaaggtgaagtaatttgagctaagttatgtaaagggagtggcaggacaagattcagactcatgtctgactttctttgcgtgtgtgtgtgtgtgtgtgtgtgtacgtaccactaagcattgaaaattggaagcgccttctcttagccctctttactgtccaagtaaccaaagtattatcttcctccttccattggaaaccaagttatcttattaattatatgtaatttaaattttttttctctctaaatttcaagtttccttgattactgttgaccaataaattgtaattttggaactgagtatattagttatttatttcccaggataattgccacaaacaaatgcagttttagaagaatgatagtgctcccagctatatgtctttcactaaaacttttaacgtcattctttgtataagaagatgagattatttatgtatcagcaataaataagtaattcttttctactagctgtgatgcatttgtacttatctacaatcacattaaatcccttgatatgacacatacatttatgaggttgctattgggtggggtagggggtgggagtataatcttcgtttctcagtcatataagctctttatgtatttctaagcatttgctgtgttctcagtcctgtacttataactatgctaagtacaaaaataacatagactgtcatgatattgtggctttcttggggactttactgggggaaaaagacacatgaaacagttatatattgttctacttggagtgcttaagtgacttagaaaaatacatccctatacaatttcaggaatagcaaagattaggccagagtaattagggaaggcatcttggagaaggtaaaatctgagactgcccctaaaggatgtataggctttagataggtagaaaggtgactgtaggtattcagggtcatgagaaatagtatgaacaaagacaagaaggcagaaatgagaatggtgtgctgaggacacagataaggacattgacctgagaggaatgtaggcattgtattgcaagtagtagatgagattacctgtatggaattggatggagtggaaaactgtgaaatccaagccaagttattaaacctgtttatataaatattgaaagatttctagtaaaatgggtggtagtaatttttctaacattttattatgaaaaattttaacatacagcaaaactgagaattttacaatgaacacccataaacccaccacctagatatgtattcatctattcatatctattcatttatgtgttcatttatcattcatctatcagttcatttttttgtatgaattttgaagtacactccttaaatacttcaacttgtatgtcattaacagttcagtgtttgtttttcttttgttctaaaatgtgcatataattaaatacatttttttcttgctgccactgaagacagaagatacacacatcttaagtgtacttttgttgagttttaacaaatacatgtatctccataatccaaacgcctttcaagatatcaaatgttactacaccccagaaagttcccttatgttccttctcatcagtttttgttcccactgcccaaaggcagtgttccaatttctccctccatagattagttttacctgttttagagtcttaataaatgcattcttaaaaactcaattttgtgtcttctttcactcaacatgcttttgaatttgtatcaatggcttattttattgcgaggttgtgttttattatatgaatataccagtttattcatttttcccattgaaagatacatgggctttttctcgttttttattattatgaataaagccgctatgaactttatcttacctgtcttactgtgaatatttttcacttttcttgggtaaacaactcagagtggagtggctgggtcagaaggtatgtgtatgtttagttttgaaagaaactgccaaaacttccaaaacattctcaccaacaatgttcaagttgcttcatattctcaccagtgtttagtaatgtcagtctttgtgccttagccatactgctggatgtagtggtatttcattcatacttattttgtggagaatctgttcaaatcctctaatttttgttgagatacttgtctctttattactgagttgtaggagtaaattgggtaggactgaatgccagtcctttgtcagataaacattttgcaaatattttctttccatggcttgcctactagtttccttccttccctttccttttcccttcttcctcttccatttccctcctcttccctctccccttgtctttcctttcctttccatttgcatagttgattaaatctctctttgcaaggttataggtaatcatttttgtgatactgtaaaacaaaacagttctatttttgtcttttgaaatgaaataagagactgtagtatatgtgtagattacatagaaatttgatgataggctgggtgcagtggctcacgcctataatcccagcactttgggaggctgaggtgggcggatcacctgagatcaggagttcgagaccagcctggccaacatggtaaaacgtcgtctctactaaaagtacaaaaattagcccagcatggtggcgggcgtctataatcccagctacttgggaggctgaagtaggagagtcacttgaacctgggagttggaggttgtagtgagctgagatcgcaccattgcactccagcctgggcaacaagagcaaaattccatctcaaaaaaaagaaagaaatttgatgatagcacttgcatttagaaccagatacagtacatcttagttggttttccattttaagtgaaaaagtaccaaaatttaaatcttaaaaatgctttttatgaacttaaaatagcttttgtaatatagagcataagttttctacatatgaataaagggtacttttccttaacataaatgggaagcacagaaaccactatttttatgcttataaatattttaaaagtatacattttattaataaataatacaccgtttggagacctactctcctcttgtcattgaagcatttaaagtattaattaaatacagattagagagtctttgagtattatgttgacccttgtatgtaaagctattatcgtggcattagagaaggaagaagtgtaattgaacacttatgtttcactaaaatgtgtttctttccattttatcaggatcttaaatgtatttcggcattgggttgaacatcatttttatgactttgaaagagacttggaattgcttgaaagactagaatccttcatttcaagtgtaagaggtatattatataaaggtttgattgaatcttatattgaacatgagtttatgttcaaatttgtgtgactttaagaaactaaaacatttctctctcttttttttttttgaaacagagctttgctttgttgtccaggctggagtgcagtggtgccatctcagctcactgcaacctccgcctcccaggttcaagtgattcttctgcctcagcctcccaagtagctgggactacaggcacatgacatcacgcctggctaatttttgtatttttagtagagatggtatttcaccacattcaccacaagaccagcctggtgtcttgaactcctgacctcagatgatccacctgcctcagcttcccaaagtgctgggattacaggcatgagccaccatgcctggccagcatttttcatttttaaaaagctgaaataacatttggaatgttttttatagacagcaagaaactcacatatgtttagaccaatcatctgaggtctcagaactttgccttttcaagtttttgaggagaatatttcttttaaagaagtcgaaagttctttttaataaatttaagctatttaattttatctcattgcaaggttgccatttcttcaactgaataaaaatatgtgtaattttatgttttctttctttaatcttattcttttaatgattaacagctttcttataatatttacatcttctggaaatgtttttggtatatttctgaaatctgaaagagaggagttttctattttaagtttcagaatcatagcccaagaaatgaaaccctaggccatgaacatttaaacaaatgtgtcatcaaatgtatattattgaatcaagaacatttatgttttatctgacattatagggcattacaaatactataacaagtgtaacttatttcgtgttctacttgttctttaaggggaatattatttaaagttaagaatgttattcctttgtttctactttgagatgtttatgatacatttttatgtgtgccttgaaattgtcataatactacattttcaagttgtattctaggccagtgcaatggctcacacctagaatatcccagcactttgggaggcagaggcgggctgattgcttgagcccagaagtttgagaccagtctgggcaaaatggcaaaacccagtctctacaaaaaatatgaaaattagccaagcatggtggcatgtgcctgtagtcccagctactcgggaggctgaggtgaagcgatcacttttaagcccagagctcgaggctgcagtgacccgaaattgcaacactgcacacaagcctgggcagagtgagaccctgtctcaaaataaacaaaaaacaaaaatttatattctaaatgagaatactggattagacacaatctaagaagcttctaaaatacacacacacattagaataaattaagtaaatggttatgttaatgtccaaagttcttttctatactagttatacttcagaataaccaaatagttcatgaggaaaagtttatttttgtggaagtatttcagctagtaagtgaagaaggaatggtagaatatcacatttctcaggtcctagtaaaataataaacctagggaattatcatgactggatgggtactatcacaaaaagttaactagacattatatgcctcctgttagaagtattcttggcaagtatttgtgtcataaaattaatcctgaatcagaccaagtcactatatctctgctttacagaaaatatagaggacagaaaaacatggcaaatgacaatttcttccacaaagtgcaagcaaaaatatgcaataaagcagtaacctgtagattaaaggagacttgagacacattgactcagtgcaatatgtgcaatcttgttcagatcccttttcaaactaaatataagaaaatatggccaggcacagtggctcatgcctgtaatcccaacactttgggaggccaaggcaggcagatcacttgagcccaggagttcaagaccagcttgggcaacatggataaaccctatttctactaaaaatacaaaaattaggccaggcgcggtggctcacgcctgtaatcccagcactttgagaggccaaggcaggcagatcacgaggtcaggagttcgagaccagcctggccaacatggtgaaaccctgtctgtactaaaaatacaacaaaattagccaagcatggtagtgtgcacctataatcctagctactcaggaggctgaggcaggagaatcgcttgaacccgggaggtggaggttgcagtgagccgagatcacgccattattctccagcctgggtgacaaagtgggactccatttcaaaaaaaatacaaaaattagccaggcgtggtgatatgtgcagtcccagctacttgggaggctgaggtgggaggatcacttgagcccgcaacatggaagttgcaataagttgagattgcgccactgcactccaacctgggccacagagcaagaccctgtctcaaaaaaaaaaaaaaaggaaaataatcagagagagaaatgtgaacagtgacaaaatacttcaagataacaatgtattaagaagttgtcagttttatgtgtgataatggtgttgtggttattactttaaagagtgttttaaaggtgcttaaatatgaatgaaatacgatgtctcggatttgtttcagaataacctaggaagtgacgggatggcatgagtagggttagagaaaataaaaattggccatgagttggtaactgttgaggctgggtgaaagttaaggattaaatgaagatttgcagtcatgtctgtcaagtaaaagacatttttctttatgtgttctttttccagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggtagacaattaatgttaatgtcttgctttatttttaagaatcttgaacattacctattttcaaaacattttgcacattattcatgagtgcttaaaaatacctcatctactctcatgggcttagaggaaaggtcatagcacagtttttaactagtctgccctgcaagtaaaagtcttatgtctagactggggactagcaatccattacaagaggaatggcaggaagattttcaagtccaccacccctcttcaactcctaataccttctcaccttggtttagtttgaggtcagtcagtcaagtcagttagtatggatgctaggcccttagcagctaagtgaatagaatattgtgtgagatgggttttcttttctcatttacagctcaggctgttgcgaagggtacaggccttgcatgtaacagctctctgtcgaaaaatgtcactatcattatcattccatcaaaaactttttctacaccaacctctctgttttcccctcctcccaatccttcccagccactaatacctgcagttctactctctacttccatgagttcattttttttttagttttcatatatgagtgggaacatgttatatttttctttctgtgtctgatttattttgcttaacataaggtcctccgggctcatccatgttgccttgaacgacaggctttcattctttttttatggccgaatagtgttccactgtgtatatataccacattttctttattcattaatctgttgattccatatcatagctattgtgagtagtatagaagcctcaatttaaaatataaatgtgcttggctgggtatgatggctcatgcctgtaatcccagcacttaggaggccaaggtgggcagatcgcttgagaccaggagttcaagaccagcctgagcaacatggcaaactccgtcatacaaaaactacaaaaaatagccaggcatggtggctcgtgcctgtagtgcccctgtagtcccagttgcccaggaggctgaggtgggaaggtcacttaaggtcgaggctgcagtgagccaagattgtgccactgcactccagcttgagtgacagagtgagaccctatctctaaaataaaaatattttcatggagttatcctgattagcagccaatttttaaataaagattacacagggaaaagcaagaatatataaaatttagtgctaataggtaatatagtaaggtacctttactacattatgtttactttatgttctttagaatttgcctagtttgcactggccatgccattcagaaccagacttttagcgcacccaccagaagttgtcaacatctgactcaaaatgttatgttatattttaagtaatttagaatccaggtagctttgtttatgttgtgggatttgtgatacgtagaaatgaagggacttgttacttgaggtaaaaaaagcaaatagtactgcatcatgttttttctcacaatgtaattgttttacatgaatggacatcagaaaaaaagcacttcacttcatgtggacctactttcaggacatagaaaaatacctaatactgacttcatttgtaaactaaatttttttttttttttttttttgagatggtgtcttgctctgtcacccaggctggagtgcagttgtgcaatctcggctcactgcaacctgtgcctcccaagttcaagtgattctcatgcctcaacctcccgagtagctgggattacaggtgtgtgccaccatgcccggcttttttatatttttagtagagatggggtttcaccatgttggccacagtggtcacgaactccttacctccagtgatccacccacctcagcctcccaaagtgctgggattacaggcatgagccactgcacccagctttgtaaactaaatttctggtgaaataatagagccactttaagaaaacatttcagaaactgttagcaagtacttatttatacacaaatctactgattaaaaaatatttttttaatgaataaccaagtctgtaggccattgatggcaatgccaccagtcaattaaaaagaaaaaaaagagatagggtctcactgtgttgcccaggctggccttgaactcctggcctcaggcagtcctcctgccttggcctcccaggtgctgggattacaggtgtgagccactgtacttggccaatttttaaattgtgtattctgactcactgtatacaatgttttaatctgctcttctgtctgaattttaattaaatactcaggcattcaaaaaatataggaaataatataatgaatattcatgaacaacaaaaacattttagataaaattgaaatcctttgtgtaattctcccaaatcttattgctctctttcccctaagaaagcactaccaccctgaatttgatgtttactatttctctttatatttttaaaatttataaacatacacggagattcataaacaacgtatagcattgttgtacactttttttttttttttttttttttagaaacagggtctcactctgttgcccaggctggagtgcagtggcacaatcatagctcactgtagccttgaactcctgggctcaagcaatcctcctgcctcagcctctcgagtagctagaactacaggcacgcaccaccatacctggctaatttttttaaaaaaatttcatagagatgaggtcttgctatgttgcccaggatggtcttgatcttggcctcaagttgtcctcccacctcaacctcccaaaacgccaggattacaggtgtgagctacagtgcccaactggttttttgttgttgttgttgtttgtttgtttaagatggggtctcactctgtcacccaggctgggatgcagtggcatgatcatagctcattgcagccccagactctaggctcaagcagtcttcccacctcagtctctcagtagcaggaactgcagggaggaactactgtgcctgtttttttttttgttttatttttttgagataggatctcattatgattgcccaggatagtctcaaaccctttgcctcaatcaatccttccacttcatcctcccaagtagctgggattataggtgcgcaccactgcacctcagcttgttttgcactttttttaaactgcatatacttatgtatcattctgcaacatgctttttacttaaatcatttttggcatttgttcaagtcaatgaatacagttctagttagcttattttagatgctgtgtagtgttccgttatatttatactccacaatttatccagtctctggatgatgagcctctattcactcttgcaaataatgcttcactgaatattcttgtaaacgttttcttataactttgttttttgtttgtttgttttgagacagagtctcactctgttgcccaggctggagtgcagtggcatgatctcagctcactgcaaccctctgcttcctgggttcaagcgattctcctgcctcagcctcccaagtagctgggactacaggcacgcactactacgcccggctaatttctttgtatttttagtagagatggggtttcgccttgttggccaggctgttcttaaactcctgacctcaagtgatctgcccgcctcagcctcccaaagtgctgggattacaggcatgagctgctgcacctggctcttataaatttgtgtaagagtttatctagggtatatgcatacttaagagtcaaattgctgagtcatccgatatgtatctcttcagtactatgagatcttgccaaattgttttacaaaatggttgtatcaatttttacttccctattggtgttcctgttttattatatttttatccatttggaattatcagacttttttttcgtttctttttttttttttttttttttggagacagagctttgctcttgttgcccaggctggagtgcagtggtgcgatctcggctcaccacaacctccatctcccgggttcaagcgattctcctgcctcagcctcccaagtagctgggattacaggcaggtgccaccatgcccggctaattttgtattttagtagagacggggtttttccatgatggtcaggctggtctcgaactcctgacctcaggtgatccatctgcctcggcctcccaaagcgctgggattacaggcatgagccaccacgcctggccttgagttatcagacttttgttcatctaatgagtaaaatgggatttcattgtagttttatgttattttccctgagtaagggataaagtgtgttttcgtgtttgtagctatttgggtctattcctctctgaattacttgttcatatatgtgttcatctgtcttttgggttaattgtctttttcttattaagttttagaagatctttaagtaatacaaatcctttataggttaagttgcactgattttcaattccataggaaagttcaaccgtctgaacttgtagggagtgtgtggaccaaagaagataaagaaataaattctccaaatttattaaaaatgattcgccataccacaaatctcaccctctggtttgaaaagtaagttttaatttactcttactacctcctaatagccataatattaagtcatatttaagctaaaattctggctactcataattatcttgttttctaagtgaggtgaagaaacttttctaagccatgaatttttgttgttgttagatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggtaagttttaggcttaactttttcatttttctcggggatgatgaaattagcataaaagaaatttcatctatcatctgtctttttaattaaattctttgtaaattcatccttgcttcataaatatgatataaatatattagaaaatatgttgatatattagttaatatatgaatatgatatataatatgtgaatcctaggcttatattagaaaatatatcaatattcaataaacaatatgagacttgcactgccgtgtaatgtacttaacctaaatgtaatgaagttccaagtggatttattcaataacacattgattgatagtctcaaatgacaaaggattttaaatataaaaatacaagtaatgtcttaattacctttaggtagtcaacaatagtataacacgggaagaactatttcaaaaacttaaatttggccaggcgtggtggctcacgcctgtaatcccagcactttaggaggctgaggcgggtcgatcacctgagctcaggagttcgaaaccaacctggacaacgcggcgaaaccccatctctactaaaaatacaaaaattagctgggcatggtggcgcacgcctgttatcccagctacttcggaggctgagacaggagaattgcttgaactcaggaggcagcatttgcagtgagctgagatcacaccactgcactccaggctgggcgacacagtgagactcagtctcaaaaaattaaaaaatatatatattttttaaattataaaatatgtgtttaacatgtactattgaaaattcaggagatatagaaaataggaagatattttgcatatatattttaataacaaaattgagattacattgtgcatagatttttatggcccttttctcataaacagttttctatttttttattagcttatcttcaaaaacaagattttaatggcatcaaggttttctatcatggataaatcataatttattccaacagtagattgtgggacaattaagttatttctgatttttttctgtgataatttatcatggaatattcatatgtagaagtctttttaagagcttgattatttccctagaaataatctaggggtggaaatcctgggtctgagtatttatatactttaagactttaaatacttttgccaaggtgtttcgtagcaggatacgataaatgccccttggtattatgtattatattaaaagcttttggccaggtgtgggggctctcacctgtaatcccaacactttgggaggcagagacaggaggatcacttgagcccaggagtttgagaccagcctgggcaacatagggagaccacatctctacaaaaaaaaaaaaaaaatagccaggcatggtgttgcatgcctctggcgggggcagaaatcgcactgcatttttaaattgtatgttaaaaaataactagtgaggctgggctcagtggctcacctgtaatcctagcactttgggaggccgaggcgggtggatcacctgaggtcaggagttcgataccagcctggctaacatgatgaaaccccatctctactaaaagtacaaaaattagtcaggcatggtggtatgtgctggtttgcaatcccagctactcaggaggctgaggcaggggtatcgcttgaacctgcctggtggaggttgcagtgagccaagattgccccactgcactctagcctgggcaacagagtgaaacttgttctcaaaataaataataactagtgaggttgaatatgtatttattgggtactttatgatttatgtattcattgcctctctcatttttgggggagggtgttttcattttgttgattttttttttttttttttcctaaagagtcaagcttgctctgtcacccaggctggagtgccagtggcatgatcatagcccactgcagtctcgaactcctgggctcaagggatcgtcctgtcccagcctcttgagtagctgcgattacaggcattagtcagcatgtccagctgcattttattcatttatatggatttttcatatattaaagatattaaaacttagactgtacatatattctcatttctgtttgtcttttatctgctttttaatttaaaaaatgtataatgctttgacataaggacgttttatcatttttatttagttgcacatatcagtctcttcacttatggtttcttcctttgcttttgtacctggaaagactttttttaagtaaaggataacaagttagaaactcagccatataaatactgcttttgggaatgtgcgtttttacaatctttctggaaagcagtctaacaatatatgttaaaattaaaaatgtgcatactcttaggacccagaattgcaaagaaataaacacaccagagtataaagttatatgtacaaagatatagttactgcagcattagttgtagtagcagaaaacaggaaacaacctgaatgtctatcagtaagagaatgattaaatacatcctcttatacctctattgtagaatattgttcagctatacaacaaagtgaatgggatctatgtgtattgttgtggaagaacatttgtgatatttcagcaggggaaaagcttcagaatgactataatattattccattttagtatcacaaagcagagcaaaccccaaacctctaagtggaactggataagtattgagaataatgtgggaggttacatactcctcttttaacattatttatttattttttttagtgggttgttattagaggggaatagaggaaaaactgctttatacatatatttttctgtttgggtgtttgcattttattgatttgtatgaactttatatgttaaagatattaatacttagtcaaatattatgaaataggccgggggcagtggctcatgcctgtaatcccaacactttgggaggctgaggtgggtggatcacatgaggccaggagtttgagaccagcctggccaacatgatgaaaccccgtctttactaaaaatataaaaattacccaggcatgctggcgggcgcctgtaatcccagctacttgggaggctgaggcaggagaatcacttgaacccgggaggcagaggttccagtgagccgagatcgcaccactgcactccagcctgtgcgacagagcaagattccatctcaaaaaaaaaaaaaaagaaatattaatgtatttaataaatgtgtcataaattgaatgcctatatctgtaggccttttgttggtctctctgttctgttcctttgatctatttgatcactcttgtgccagtgccactagtctaaactatcataactttatagtagtccttgatagagaagagtagggcaaatcctcgccaatcttactctttttcaggaggaacgtattcttggttctttgttctcctatatacattttagaatcaatttaagctccatttttttaaattggcattttgataggagttgcattggctctctaaatccaattacagattagtgaagaactgacatttttatagtaacaagtcttttcaactgtgaacatcgtttatctctttatttactcagttaataaagttttgtggggttttttttgttttgacagagatcgcatacctcttttgctagatgtatattagaattattttgttttcagtgacccttagagacagggtcatgctctgtcacccaggctggagtacagtggcatgatcatagcttactgcagcctcctattcccaggctcaaacagtcttcctaccttagtctcctgagtagtggggactataggcacgtgccaccctgctcagctaattttttaaattttatgtggagattgggcgttgctatgttgcgcagactggtttcgaactcctggcctcaaactattctcccaccccaacatctcaaagtgctgggattacaggtgtgagccactgcacttgaccagaattttttttttttttttttttttttttttttgagacagagtctcgctctgtcacccaggctggagtgcagtggcacaatctcggctcacggcaagctccacctcccaggttcatggcattctcctgcctcagcctcccgagtagctgggactacaggcacccgccaccacgcccggctaattttttgcatttttagtagagacggggtttcaccgtgttagccaggatggtcttgatcccctgacctcatgatccgcccgcctcagcctcccaaagtgctgggattacaggcgtgagccactgcacctggcctcagaattttttttaaatcctgatttctttattgatgatatctagaaatgcagttgatttttgtctattggttttatatatagcagcattgctgattctctcattaacattctatatgtagatttattggagtttcctcatgggcagtcatatcctctgtgtgaatagtgacatttttttttctttccaatctctagctctttatttcttatacttgtccatgctagctaggacttctgtatagtattgaataaaagctacaatgttatacccttggctttttccttgatttaaaggaaattgactgaatggttctccatcaagcatagtgttcgctctggggtttacgtgtgtgtgtatattctttctgaagtaaaaattaattttcaataagaagatctagtaatgaagtataaaagaaatgctagtttacttcattcactaaatttttgttcaagtcttcttgtcttctgatagttgtcttctccttaacaaaaccccaacctttagccccaaaagatctttcagtggaaaaatatttgaatgttcaggggttataattttcatcttctacagctatgacttgaaaccctggctagtcaaaataacgcacaaggcatgacgtagaattttttgtattgcttgatcttctaatttatatgagtaaattatgggttttatatttatagataaagagaggagaaatcacttcaggtaagtgtacaaaggaataccactcatcttttaatgtaaaaaaattgttttccagataatttgcaaaattttataaaatttaaaggtttgcatttataaaatatgattgaattgtaaaaaatttatactcaatttatgtatactttaaggcactgcaggaaaggaaaaggaaaattttggacgaagctgtggaattaagtcaagatcactttaaaaaatacctagtaaaacttaagtcaatcaatccaccttgtgtgcctttttttggtaagttactaaatatggatatattttgagggtgagcgtgtgatagccaaaagagagcagtcttcagaggcatgttatctttattttatatctgagctcatctacttttattagctctctgtattaataaataataaaactctctattttctataaaatgaagactataatatctcatagggttgttataaataaggattaaaaatattttgtctgtactacctaataagtctagcacataggacgcactcatgaaatggtaactgttatttttatcataactatctatgtcacatctacagtgtttgctttctctttaatttattaaaagcttctatgtgatttttaaatttagaattaaaatattgttgtgtatgattgaaattgaatgatttaaatcaagttttgtcaacttcaacaattttggtattttgggccaaataattctttgttgtgatgggctgtcgtgtgcgtaataggatctgtagcagcatcctggcctctattcattacactccaatagcaccctggagttgtggtaaccaaaaatgtctctagacattcctaaatatcccctgggggactaaattgtccccagctgagaaccaccaatttaaatgaatcagcaattacgcatgaaaaagggactaaaaacttttttattgttcatgaatgagaagtaattatttttctatctaaattacagtctctgaaaaaacagaattagtttataagcctatagacttattaaccaaaattggcttaaaattaatttattaataatcacctaagatacttggcattaaatatttataatcaaatattaaaatatttggtcagaatagatttaacacaatttgcacttggtgaaattagagtttagaaaagcttaatttgccatttcttagattagcagcctttatttttgtacaagccagtagcttttattttctttttattttaaattctttctctttaaaaaatgcttaatggagagttaatgattgtttatcagagacttaacattttagtagtagagttgctgaatagtataggatgtctttcaactttactagatcagttgttttcccaaataattgattaaataacaaaatttaaaataacttttctttaaattctttttttttttttactaggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgagggtaaatattttctttgcatatctttagaagagaacgtgttaatgggtaccaaaaaaaaaaaatagaatgaataagacatactattggatcgcacaacagggtgactacagtccataataatttaattgcagatttaaaagtaactgtaagaggccaggcactgtggctcacgcctgtaatcccagcactttgggaggccaaggcgggcggatcgcttgagatcaggagttggagaccagcctgggcagcatggcgaaaccccgtctctactaaaaatataaaaaaaaattagctgggcatggtgctgggtgcctgcagtcccagctactcaggagtctgaggtgggagaatcacttgagcctaggaggggtaggttgcagtgagccgagatagcgccactgcactccagcctgggtgacacagtaagacttctgtctcaaaataataatagtagtaataactataagtatcggctgggcatggtggctcacgcctgtaatcacagcactttgggaggctgaggcgggaggaccacttgaggtcaagaatttgagaccagcctgaccaacatggtgaaaccctgtctctactaaaaatacaaaaaattagccgggcatggtggcgggtgcctgtaatcccagctacttgggagactgaagcaggagaatcatttgaacccaggaggtggaggctgcagtgagccgagatcatgccactgccttccagcctgggtgacagagggagactccgtctcaaaaaataaaataaaaaatattaactataagagtataattggattattcataatacaaaggataaatgcttgagggaatggataccccactctccatgatgggattattctacattacatgcctgtatcaaaacatctcttataccctacaaatatatacacctattatgtacccatgaaaattaaaaattttaaaaattaaaaaaaaattttagatcttgtgtgacctgtaagaaatatcataattatttgtcttgctatgaaaataatagaaaaaaattaatcagtagatagcatgttaaacattagacattctacactatctgcagttgttaatattgttactaagtactttcttttgaaagtattgcttctttgtgtagttggttcaagctacaccataaaaagtgaatgacaaagtagaatgatgtccatgcagtaaaaagaaaattcatttctagatttgatagccattttagataatgttacatgtagcaaaataacgttatataattcataagaacagtgtgtttaaataggaaaagggtcagcaaagtggtatatgtatgcctggcagaagatgatttttctaacatcctgtcgattgatgttctattttgagcaatagtgtgtaatattgatactatagtactataaaatatgaaacaaccttctaaattaaactatgatattatgtttatgctaaatgaatgttattatattatacttgaacttgggaacatattataactatcaaccagaataagtttacgtgtcatattaaaaactgcgctaaactttttagacataatctgcatgcaaattgggcatattgagtgaaaatatccaccattacttccaccctcctaaattatgagatagaaacttctttgttcccggttcaaaacaaagtaccctaaagtcctaagaaaaagaccacctaaagcataccatttataaaaatgataggtcgggcacagtggctaatgcctgtaaatccagcactttgagaggctgaggtgggtggatcacctgaggtcaggagttcaagaccagcctggccaacgtggtgaaactctgtctccactaaaaatacaaaaattcgctgggtgtggtggcacgtgcttgtaatcccagctactcaggaggctgaggtgggaggatcgcttggacccagaaggcaaatgttgcagagaactgagatagagccactgcactctagcctaggtgacagagcgagactgcatctcaaaaaaaaaaaaaaaagatacttgctcttaaaaaaaataaaggtggtaacctactgatggtgacctatttcatcccctctcaccattgaacccgccctctgtgatgtggggcttcggagagctaaggaaatatggtccccacaggaataatgttacactttaattcggtatgcttgaaatagtacttttagtatttatatctcagaaccatacctgctaattggtgtttgtggtgtggtctagggttcctaccaccatttaaagcatttttgggaggaagtgtcttctatatgattgagtcaaacaaaataaatttaaaatgtagacaaagtagctattcacttttcaaatcatacttaaataaatagtatttaaaatagagcaaaggatgaggaaatcaagaatactgctgttatagctttctgaaagcctttaattactagtggctaatatttaatttagctaacctgaacataagaacacattgtttcagtattgttaaaagagtaatacaattttcttgaaattggcagaatgccttaaaaatgggaagaattttatactagaaattttaaagctcattttgcctactgctaaagctaaaacctagtaccatttttatatatgcttctaaaccacttcaaaattaaataaagctaaatccagtaatttgctgctaaggaatttttctaaggaaatcataaaaaatgtacagaaaaatttatatataggagttaataaaaataattattataatagcaaaaaattagaaagtacctatatggataactagctatatggagattattacattctgaaatatccatctgatgaaatactatagagttaaaatttgtattttgtaaaataagcaaactggctgggtgaggtggctcatacctgtaatcccagcactttggaaggctgagtgagactccatctcaaaaaaaaaaaaaaaaaaaaaagcaaaccacattgaaaaaagttaattgaatataaacttcagaaagattaaaattgatatcccagtttttcaggaaaatatatatataaattattaataattatatataaatacatatatacatgcatatatttacatgcacagtaaaatcattggaagatagtctaatatttaaatgtaaacaatgatatttctggtttgtaagattactgtttctttttctttttttctctttttttggcagtgctaaatcacctgaattttctacgttaaaacttaaatttaagcttaaaatattttttgataaagacaaaaattttaaacattttatttattaggctttttttaagaggagaggtctcaccatattgccctggctggtgtcaaattcctgggcttaagcagtcccccggcctcagcctcccaaactgctaggattacaggtgtgagccatcatggcttggctcagataaaaacattttttatactagaagttagcacagataggtttaactttataatcattctttctttctttctttctttctttctttttttttttttttttttttgagacagtctcgctcttgttgcccaggctggagtgcaatggtgtgatctcggttcacctcaacctccgcctgccaggttcaattgattctcctgtctcagcctcctgagtagctgggattacaggcatgcgccaccacgcccagctaattttgtatttttagtagagatggggtttcttcatgttggtcaggctggtctcaaactcccgacctcaggtgatccacccacctcagcctcccaaagtggtgggattacaggcgtgagccaccgtgctcggcctataatcattcttgacattacttttaaagtaatttaaatgactacttttaaagtaaaaggaatttccagagtaattataaatgatcaagaatgatctataaattggattaacagaccttaatctaatttatctccactttttttctgattatcaaaacttcattgtggattataaccatagctttgttctaaacacttttggtagcttactagtgatgatcatttgttacaatgagtaggagtaaagtttcctaaggaataagtagtgctactgctgagccattaaaatgataataaatgaaaactcatattcttaatagaactttaagactagaatataacttccacagaaattatataatcttattcagaagtaaagagattggaataagcaacacttgtgaacttttcacatattgtgggctcttaatgtgttattttttagcattaaataagtaattttcagcaaaaaattttaatgagatcttattttaataagatctaaaatatatacttactatatatgcacttgtgttatttgtttaattccagagattctttgaaaaccttaaccccatgggaagtgcatctgaaaaagagtttacagattatttgttcaacaagtcactagaaattgaacctcgaaactgcaaacagccacctcgatttgtaagtcttttataatttcgggaacaagtgttctgttttttaaaatattattttcaatgtttaacaacctgttatcttaaaaatgtaattgaatggctgttcctaggtgttttgtttgcagtaatatactatttctaaaactggggggggaaatgtcagccttttgataaaatctggtttatgccttatcttggtactacttatttatgtgtctacttttgatccctcctagaataatacaaaaaggtgtgagaaagtgagaacttaataggtagctgaatggaacagaaaaaaaaagaaaagacctgggaaggagtaagcaaatgtattttggttcttgtgacttgatatgacttctgccattagggctccatggtccatagttgcctctggaacccatctctgtcactagaatttgatgctacaatttccagttactgcaggagtttgcagtggcaacagaagtagtagaagatgaactctaagtagctaaaagtgaagcaagatatagaaggaagtaaaaacacaaaccaactttaggtgaagcaggaagtcaggtagtttcatgctatctcatcttcacaattgtgtgatatatgaggggacttcaaaaagttcatagagaccgggcatggtggctcacacctgtaatcccagcacattgggagaccaaggcaggcagattgcttcagttcaagagtttgagaccagcttgggcaacatggcaaaaccctgtctctaccaaaaatacaaaaaaattagccaggcatggtggtgcacgcctgggggcggaggttgcagtgagccaagatcactccacttcactccaacctgggtgacagagcaagaccccgtctcaaaaaaaaaaaaaaagaaaaaagaaaaaagaaaaaaagttcatggaaaaatggaatgaaaagataaatttttttgatggaattaaaagataaacataaaaacataaactttatttcccaacataagcttcctcaagttcaggacacttttgtaagcgctaataccaaccattttgtccatccctaaaaaactaaagatcctgggaatttaaccatatcattgcagtctcttttacattattaactgaagaaaaatggttgccctttaatttttttttttataattaggaaacaaaaaaagtcagaaggagccaagtcaagactgtaagtggatgcctaatgatctgccatcaaaactctcaaagaattgctctggtttaatgagagggatgagcaggagcattgttgtggtggagaaggtctccttggtgaagctttcctggttgtttttctgcaaaagctttggctaactttctcaaaacagtcccatagtaagcagatgttattgttctttgaccctctacaaactcaacaagaaaaatgccttgagcgtcctaaaaaactgttgccatgacctttctttttgtttttgttttgttttttttgagacagagtctcgctctgtcacccaggctggagtacagtggtgcaatctcaactcactgtaacctccacctcccaggttcaagcaattctactgcctcagcctcccacgtaactgggataacaggtgtgtgccactacgcccggctaatttttgtatttttaatagagatgaggtttcaccatgttggccaggcatgtcttgtactcctgacctcaagtgatccacctgcctcgacctcccaaagtgatgggattacaggtgtgagccaccatgcccagccttttttttttttttttttttttttaatggcaatagagtcttgctatattgcccaggctggtctcaaacccctggccttaaatgatcctcctgcctcagcctcccaaggtgctaggattacaggcatgagccactgtgcttggccaacctttgctcttgactgatttggttttgctttgactggaccacacttccacctcttggtagccattgctttgattgtgctttgtcttcaggatgatactgggaaaccgtgtttcatttcctattaacagtttttcaaacaaatgcttcagggtcttgatcccacttatttaacatttcattgaaagttttgctcttgtctgcagctgatctgggtgcagtggttttgccatccatctagtggaaagtttgctcaactttaatttttcagtcagaattgtataagctgaaccagttgagatatctgtggtgttggctatcatttctgttgttaatcataggtcctcttcaattagagcaggaatgagattttttcctcagaaattgatgttgatgatctgccgccattggctttaccttccatatcatctgatcccttgttaaaaatgagttatcaatttgtaaacagctgatttctttggggcattgtccccataaacttttcataaagtattagtgatctcaccattcttctacccaagcatcatcatggatttgatatttgttcttgcttcaattttagcagaattcgtgttcctctgatagggattctttacaaaccgatgtgttatccttcttagtatctcaaactagatatgtttgagtatctcaaactagatatgtttgagcatctcaaactgttcagacatgttataataagttagtatgagtttattttgatggaaaaaaatgaaagtcatgcatagttatttcataatagacatttgccatgcactttttgaaaacccctcatagatcttattctcattttacaaaggaaaatagtgagattccaaggggttaaataagtttttcaaggctgcatagctagatattggcacagttgagatcttaactcaagttttctgatctgagttctgtgttttttatttgattactcctgccagaacttgaaaaatgggacagaggtgatggtgggagacaatgataggaattttctccaaagatttttaaagcatcaatgtagaggttgatcatttagtataggaaggggaaaaaatgatcttttttttttctgaagcatatagcataatatgtttcataaattatgttcccagtaaatgtttgtaaaatctatatagatattttcaaagagaagtttaggttcatatgttttaggagtaaaatgtgattttcacataaaatttcaagaattttatttctgcagtgctgaaaagagacttacttatattccaattcattttaaaattaagccagtcaaatccagaagattctactagaatgatacaggctgtcattgcagactgaaggactgcacgcttaagaactgtatgcttaagaactaataagactaataaggtagctctaagtcacagaaacaaattgttgtctatgcaaatttgtgacattaattatgtttgcttttctcagcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggtaagtatttgatgtaaaccgcttggtaaaaaaggaatcctgtgtctcagataattcttatcattttaattagggaactatagaatcctttgcaaactatattagtgtgaaaagtgatatctaaatgtgaaaataatgattaatacaagaagtagagcataatttgtgcattgttgatgcatattatcttctaatttactcattcaacaaagatttgtttagtaccttttgggtcccactaccagtctaaagggagcaatagatgatgaataagaaaacaaatagataagttctgtgatagagggggaaccacttaatgctaagaaggaaaaccattctagatacagaaggttctgagttaattttttaaaaaactaacatggcaaaagatgatgataaaattctgcactgtgtattacgtattatttatggaaacatttaaaaaataatacctacatgttaccttccttttcaaattaatttttcttattccaataggcagcaatagcatctttgctccagtgcttttgccacattcaagtaagtataatttaagttgattcttaatgaaatgactgtaaagataataatctggttgattatatttgagtattttgagttttggcaatattaaagaacaagaaaagttataaataaatttaattatttgcttacaactgtgtactacttaagcttcactatagtttattttcatcattttttatgatctgttctaagggctgtatggccttgaagaaattacttaccttccccacacttgttaaggattaaatgaaataactgtatagaacacctagccgggtgtggtggctcacgcctgtaatcccagcactttgggaggccaaggcaggtggatcacgaggtcaggagttcaagaccagcctggccaacatagtgaaactctgtctctactaaaaaattacaaaaattagccggatatggtggtgcacgcctgtagtcccagctactcaggaggctgaggcaggagaatcacttgaacccaggaagcagaggttgtggtgagctgagatcaggccaccacactccagcctgggcaacggagtgagactccatctcaaaaaaagaaaacaacaaaacaaacaaacaaaaaaacaccatctaaaatattgcttggcatagaatgaatagtaatttcatgtcagttgtctttcttccttacccttttcaaatcattttcccatggcaataatatagtaaatgtttatcaggttcccgggatatcctcagtcacttatttttttttacatcatcttatttaattaaagcagtaaattttaagtaaagcactattctatcattcctaattatttcataatttataacttttaatgctgtaaactttctttctgtggtcatttgtttaaaacaaaataactcaaaaatgaacacagcacctttgggtataattctctcaatctggagaacatctgcttcgagcatagtaaaatatatagtagcaagtttccctatcttatgagaaaaataagcttagtcttttaaatgtttaattttatattttaggttaaaaaatttttatctggccaggcacagtggctcatacctgtaatcctaccactttgggaggctgaggcaggagtatcacttgaggtcagggcaacatagcagttcaagactagcctgggcaacatagcaagaccctgtcctccctaccaaaaaaaaatttatcaaagtgacatattaatagaatttaaaagggaaatagtgctaagacacttaaaatgaaattaacagtggttctctacctcaagtctccccactccttttcttgttctccaaggacacttccacatttctaaatgatgtttttgtagtctctcttgagtcattaattttagacaatgtttactgatctcctcttatggtggatgagaatttcatgtctaccctgcctatacttaaccacatttggggcaaatattattcactgctatgcttcctttcttgtatagctctgtttcctggagttcataattgcctcattaatgtttagatttgtttgtttgtttaggtttgtttgtatgtttgtttagcacctttccatgccctttcatagcagttttccataaagtcaggcaaatcagggaacctagcagggttttcctttttcttttcttttcgtttccctttccctttcccttctttctttcctagaatcttccttcctggtgcctttttgtcccccgttccagtttggactggttgatattcaggtattgaccctgctgtcatcctagaactttctttcattgtcatcctagaaattccctttgcctccctcctgtgttggatccttgtttttggattcctcatcttctttcttgatatgctccctgattttaataggagtagctcctttagtagctacgtgagaaaagataatacatatgacttaaactttttaagttattgcatatatggaaacctattatacctttttttgtttattttgtggaagcctattatacatttaattgttaatagtttagctggaaatagaatgtaaaaaataatttgactcagaattttgaactcattttcctccacggtcttctgcctttcataattcctgctgaaaagtctaataccattcatttacttactcagtacataatttttaaatgcctgataatgtgcaggcactattctagatgtgagagtgatagcagtgaatgaaatagacaaatatctttctctcaatgatcctacagtttcaatctttttttaaacttagagcatacttaacagtagcagaggacccaatgtcatacagagggacccaaatatacagagccttaaatgaaatagaagtttattcctcacaatagccagagcaagtaagcaactctgctccactgggttttccagctaagcagggcaattcagaattctcaagatgtgacttccatctctgtcttgagtacctgctgtagttgttaccattttctggctagcaggaagatggagggcaaggagctttgttataaaaacatgatctgggccgggcgcggtggctcacgactgtaatcccagcactttgggagaccgaggcagacagatcacctgaggtcaggagtttgagaccagactgaccaacatggtgaaaccccatctctactaaaaatacaaaaattagctgggcatagtggcgtgtgcctgtagtcccagctatttgggaggctgagacaggagaattgcttgaacccgggaggtggaggttgcagtgatccaagatcgtgtcattgcactccagcctggggcgacagagtgagactctgtctcaaaaaaaaaaaaaaaaaaaaggagaccttcttagttacaaaggaagctaagaaacgtctctaactaggtagccatttgccttaccaaaattcatgggatcctattactaaaaggaaaaagggaaaggtgtactgggaagcagcaggctctgccacaatatgttgaagaaacttttaaggcattctctttattcttaataatctacagcttcacaatgaactgcattgatgtgggtatttttttttttcattttgtcatctacttaatgagccctttaaatttagagattcgagtgttcgatttccagaaaatgcttcctgttgctttggtaataatttttcccccagcatgttctctgactccttttgtggagctcctttttcttattctcatacatcctagattgatcctccaattttcttgtcttttatcacctcttgtccatctctttgtcttcttgttctgttttcctggaagatttcctcactttatctttcagctcttctatttattttcttcatctgtcataattttaaatttctaagaattcttttcagttacctctgattgtgcctttttttaatagcatcctattctaatttcatggatgcactgtcttatctctcttaggataataattatagtatttttaaattttatttttaatcgacagataattgtatatgtttatggggtacaatctgatgttttgatacattgtggaatgatcaaatcagctaagttgcatatccagtggctgggcagggttggaccaggaaaggggagactttagtcaatggatgcaaagtttcagtgactatagttaataataatgtatatctctggatagataaaagagaagattttaaatgttctcaccacaaagaaatgatgaatatttgagatgatgaataattacagtatttttgaaaaaaaatttgttttgtttctagtgttgtctcttttctgacctcctttcttgtattagttgtagtctcttgtctttcatattggaggctttcctttcttgtccagtagtatttctgttcatattttagaatgagggggaaactgatgggaagtgctgtatctatatccatggcacttattgacttgtgggtttcactgtagagtgatggaatgataattttttacttaggaaatccccaaatgttagaatctgtaggcattttctctaagaatgtttagtttctctaaagaaggatctttgaatcttctgcctggggcaatctcgccatgtagtatggatatctgtgttttcagctcagactagtatcccaagtctggggtttagattttccggagaataaaactgccagtctcctacagaggtgggaatgaggtcattgcctggcctcactaagtaggggagaggagaatggggttctaactctcccttatccagacttaaccaagtcttctgttttcatgtccatgccttcctttgtaccaaatgcctttagctcctgaatccttatttggttctgtggggcagatttgctgctgcttgtcagtattactctctgtagggtttcatcttcctccatctgtctccatatacattataatctaccttcatgaattaaagcttcagcttcatatatttcctggctttattgaagtttgttgatatttcttatttttcttgttgttctgtggtggaaatgtcattacactattagtttcttagtactgccataacaaagcaccacaaactgagtagcttaaaagagcaaaaatgtattgtcccacagttctgaaggccagaaatccaaaatcgagatgttggcagggccatgtttactctgaaacttggagaagagaatccttccttgcttcttctaccttctggcatttgctggcaatccttggcatctcctgatttgtagatgcctcacttcagtctttgcctccattgtcatatggctgtcttctcgcggtatgtttctttatttcttctcctcttcttataaagacactggtcatgtcatattggatttggatccattttaatgacctcatcctaacttcattacatctgcaaagactatattccaaataaggtcacaattataggtactaggttatgggacttcatcatatctttgggggaacacaattcaacccataacactgtgccatcgtagaagtaggaattctagacattattttgaatggtagtaaaatacattttccatataagaaaattttacattttgaaatttaatagaaaattgagaataactgcattaaattctgaatattctaaaataaatccccaaagaaaataaaatattcatagcaagtatgaaaagtactcagatgaaatgagaaaaatggcaagactccattcacaatgaacatgggtacttcacatcaaaggaagtataccttgtaaagaaacatagataattatagatagttcagcatcattagaaatctgaggaattttacacaatagtgagttgccattttagtcttttgaattaatgtatttttttttgttttagtacgagcaagcctatggtaaaaggcacattacttatccccatgtaaattggtatattagtataacccttttggaatctgaatacaacatatcaaaccataaaaatgttcacaccctttgatgttactgattcagtagataattgaatacttagtttgtaccagttaccctgctaagcacaagagattcagtggcaaacaagaaagacaacgcctctgccttttatttatacaaaatacccaataaatgtttggaaaaagttacatgcatgaagattcatcctactgtctcgtcttttcttccacttcacttgtcactgcttggtctctcttgctggttcctcctcaccttcccaaactattgacattggaaggccttaggactcagtttctggacctcttctcactcacttggttgttcagtcttgtatcgtttacatgatgataattcccaagtttatatctagccagaacctctcttctgacttctagactcatatatttaattacccatttaacatctccagttggatatctaataggaatctcaaaccttacctgtctgaaactgagcttcttattatcccctccaaagttgttcctctcactgcctcctcatctccattctaattacaagcatccagttacttaggctaaaaatagtgtaatagaagtatcttttacttctctccctttctcacacgccaaatgtgacctatcaacaaatcttgactactctcaaaatatatccagaatctaacaattttttgccatctccactgctgccaccctggtccaagccaccataacttttaccttgtttattacagtaagcatcctgacttattatcttctccacttcagtatgtttttagtagagcagccagaatgatccttttagaatctgagttagaccttgttttacttgtgcttaaagccctctggtgggccgggtacggtggctcacccctgtaatcccagcactttgggaggccaaggcaggcggatcacctgaggtcaggagttggagaccagcctggccaacatggtgaaaccccgtctctactaaaaatacaaaaattagctgggcctggttgcaggcacctgtaatcccagcatactcaggaggctgaagcaggagaattgcttgaatccgggaggcggaggttgcagtgagctgagatcacaccactgctctccagcctgggcgacaagagtgaaactccatctcaaaaaaaaaaaaaaaaaagccctctggtggctttccatctcactcacagtgaaagccggttcctttaaagaacgcacaggccctacacagtttgggcttgtttgatctgtcagacctcatcacttattctcccccttcactcagtctgcctcaacataatagacacattattgcatcagtgctttgctcttgccattcctgctgtttataatacttttcagccatttagcctcacagcctgctcccttacctccttcaggctgttaccttagtgaagccttccctaatcaccctatttatgttgctcccctcccacctctttctatacccctttccaaccaaatatttcttgtcataatttataggcatcatacttttacttatctttccctaacctagattataagttccataaggacgtgaatttttgagttttgttcacggttatattgctagtgcttcagacagtgcctgacagtattagcaggtgcccaataactgttgaatgaatgaatgaatggcagaaaattagaagtaacttagatagctaactaacattacagaaattgtttagtaaattctgctatattcaccagtttggaataaatgcaggcactaaaaaagttcataaagactgtagtcttgtagggaaatgctcttgatagacaattaaattgcattcagacttcagcaagggttattgattgcctaccgtggagaaatatactggttaagtggtgactgtagagtcagacccagattcagagctctcatagctttcccatcattcacatatcatctgcttccatgagtgtgcgtgtctgttaccacctaagactggcttaatcaataagaaaacactcagacatacttggaagcctagaggaaggctgctttaagactggttgattcagtgactcgatgatgtaattaaagaccagggttcctggactccagcctgggcgacagagcgagacaccgtctcaaaaaaaaaaaaaaaaaaaaaagcccagggttctttttcactcttcattgttttgtccagattatcagcttgatttaaagctgttttccctcaaaatcataactggcaagagcagtaaaggttgtgtgcttctttgttcagtcaaattatatatagagagaagtacagacaagacagtatgacagaatgcgtttccaaaaaagagcaaggaacttcctttccattagcccccagaatatctccttttaaatttcactggtctgaattaggttacatgcctacagttaaactcatcactctggctaaaggaatgggattactctgattgatttataccaattaggccccatccctggagctaaggggtcaggttcactttccctaaaaaaatggctacttgcatgaaagagaggtagataaaaatctgatcatgttaagaaagtgagtcccatgcctattccttgccttgaattggggtgtcctgggcaggattggccaactaaaccaaatgggacagatttaccaccaccgaaaggagttctcccaaagacgggacaaacaatgctggcaggtctgaggaacatcctctgcctaacctccccacaccatctgccaacctcataggcataccttttgtatcagctatttccccctgagccaacaggacacccccgcagaagtaactgcagagccacatgactgagatagcaatttttgacatagaataattagtttgacatatctacttggatgtctcataagcagttcagttcagagtgtttaggaacatcctctgcctaacctccccacaccatctgccaacctcataggcgtaccttttgtatcagctatttccccctgagtcaacaggactcccccccctcccccaggaagtaactgcagagccacatgatcgggatagcaatttttgacatagaataattagtttgacatatctacttggatgtctcataagcagttcagttagagtgtttaaagttaaacttatcaacttctttcccagttagcgcctgtgttcccaatctcagtataatgacaaataagacatagttgctgcctttgtaacaactgtgtgaatatagagagatcaaatgggaagttgaactatagaaaaaattaaaatgaagatagtaattattatatgtctggttgatctgtttaggggtattttcctgtcatttatcattttgtaaatttcctttaatgtagttatataacgtgtacattatcagtgagagacttgcaaagacaaagagttatgtgatataacactaccttatgggttcctatatggagggttttattacctgtgtggtgatgtgcccaatcatagctgcttcaaaaatatacggtctcgcagggcacggtggttcatgcctgtaatcctagcactttgggaggccgaggtgggcggatcacaaggtcaggagtttgagaccagcctgaccaacatggtgaaaccctgtctctactaaaaatacaaaaattagctgggggtggtagtgggtacctgtaatcccagctactcaggaggctgaggcaggagaattgcttgaacccgggaggcggaggttgcagtgagccgagatcgtgccattgcactccagcctaggcgacagagtgggactccgtctcaaaaaaaaaaaaaaaaaaaaaggtctctgattaggatggtctttctttggaagttactacagtgtatttagacatgttttgttttgatttgtgaaaggcttttcagggagcagaatctcattaatcataattaaatagtacaccttcatttagctgaagtacccatcatgccccaggcactatggttggtgctagagacacagaaataaatacacactccctgcagaaagcttacaatttaatgggggaagatagataaaccaatagttgatacagtctgacaaatgccatggtagaagtatcgatcacaaattgtgataaaggtttatcttatactgtgaattgtggttaaactagtctttttctcccccagagtctttctttagttcatgtggtagtttacataaactaagtgaagagcccctgattcctcctcctcttcctcctcgaaaaaagtttgatcatgatgcttcaaattccaaggtaatcaacaggactttactccaacttattcaaagttgtgaatcttcaaaataatgcctagtgttataaagagtctgtgaattatactttggctaccatttatggtttttcagcatttgggttgttatatttgaaaaatacttttagttgtttaatccttataaaaaccttttctaaataagaggctgggccgggcgcagtggctcatgccaggcgggtagatcacctgagatcaggagttcgagaccagcctggtcaacatgatgaaaccccatctctactaaaaatacaaaaaattagctgggtgtggtggcgggtgcctgtgattccagctactggggaggctgaggcaggagaagcgcttgaacctgggagttggaggttgcagtgagccaggatcgtgccactgcactccagtctgggcaacaattgcaaaactcttgtctcaaaaaaaaaaaaaaaaaaaaaaaaggctggttgggaggctgaggcaggcagatcatctgaagtcaggagttcaagaccagcctggccaatatggtgaaaccctgtctctactaaaaatacaaaaattagccgggcatggtggcgggcacctgtaatcccagctactcaagaggctaaggcaggagaatcacttgaacctgggaggtgaaggtaggttgcagtgagccaagatcgcaccattgcactccagcctgggcgacagagcaagactctgtctcaaaaactaaaaataaaaataaaaaaataaaaaagaggctggaagtacattttctttctggtacaggtggaaaaaaacttcagtagtattccaagtattcttcaaactttcaactaatgcttctcaaaattttaagggtgcatcagaattacctgaaaggcttggtaaaatcagactgtggagccacacctccagagtttctgattcagtagtctaggatggggcccaagaatttgcttttctaacaagttccctactgatgctgatgttgttggtctctggatcacactttgagatctactgctctaagcctcactggagaaagtagcagtagatgcccagtaagcagaagctagacattaaagtcctctagacatcatgtcctttcatgtctataaagcaataaattattgtcacttacctactattataattaaaatacataaatttctgaaatgtatacacaaagcaagataaagagttaggacctaagacttaaattaaaacatctcatatataaaaatattaaacccagccctgaattaatctaggagtactcataatctgataattaacccagattagtttattttgagcctctgaatttaacttgacaagtaagaatttttcagacttaaaaatttttttttttaatttttcagaatagaggtataatttaattacttttttttttgagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatggtatttgtaaagttttttttttaatttattcaaaaaaagacatagtattttagtactttttacaaataatgctcttacaaaaatgctactgatcaaataagcttttaagaattggaaaaataaaaatacaaaagtccttcaccattatcctcaggtgatcagtagcattgccttgtcttggatcctcagtgctgccaaaaggccagtataaagaatttatatttgcactgtaaactctgcaaaaatatggtttaaagtgacatgattgcactgaaaagggatagtgcttttgtgaaatttttcaaatttgagtaatagatgcctttttaaggcagtgaatttacacaaatatgggaggggtatatggtgttactgatttttaaacctctttgaccatcttctagtttttacttctagtttttacatctaggagaattgtgaataacaccaactgttcttaaactctttaatgccatgtcttaaatgccggtatttgctgctgaagacaaaaatgaaaagtaggatgaaaataatagaatggcactgtaagtgtttattattttgtcaaaatgtaaacaaagactacataacccaatgatggagggaaaaagggcatgtatctcattcagatgtgccttttgtttttgcagactatgacgtctttagctaatgaattgcctattgttatggaaaacagttaatatgccatgtatgtacagttttgtttatattgtatatttaaagatactgctaataacctatataaatttaagtgacttgaggcctataatacaatctgctactttactaattcataaattcaaaaaaaattctatggcataggaaccaactgccttgccttcaagacctagtaactttctctataaatctcgtgttaactgaaattttttttaaatatattttttagattggtaatatttaaaccagcaaatacttaaagctttattaaacattttaatcagataagtgagtaaagcttttatttgccatttggatgccttcgttcaaagtgatagagtgttttgctgatagtgctgtagcagcagttgtaaagtagccaaaagccacgttgtttatttactggtttgtggccttttactgtgctttgtatcagagttcttaacaagattaataaatcaccccagtcttaatttttaaaa

SEQ ID NO: 2 - DNA, 114449 bp, Homo sapiens
  source 1..114449: mol_type = genomic DNA
agaagcgggccagcgccgccgggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggtcagtgctaggggcggggcggccggcgggtggcccgtggccccccgagcttctaacggggagcaggtcgtccctcccacagggctcgagtccccggggccgagccgtttctcgttggctggcaatggggggctcacaattgcctgttgcattctgaaggacgtttctcaagttttttttttttgcctggtcccggaaggaaggttttgttatgatcataaaactggatttcatgttgcagtcatttcgtcaggcaacttccgccgttgaccaatttgttgtcctcaggctggaatcgggcaagagaaagtcccgctggtatttagacagtttctaaaacaaaagcacattttcaggccgggtaattacttttaattaagttctttgggagtgttccccctaggcggtttgcttgtcaagggtatccacttatgaggcaatggttttttgtaatatggatgtttcacatgtgtgaaatgtcagtgagtcataatattcttattcattttacagttctcaaggtaaatttaaagcgccttcccacttcctgcaaacggtgtcttacctgtttacaagagattacccttagaaaatttggtcagtgtcttcagtgtcttcacgaccaaattgcgatttaggacttgaaatcattttaaggaacaagaaaggggcaactcctgcaaatcagtctttcatgtttgggtgcattgctagggtgcatctttcctgtagatggtggcggtcttcctctgtgaatttaggtagtaaccatacgatcatttttataataaatccttctgtaagatcaagacatttaaagactgtgaataggtgcgtgatcagctgtcatgcctgttgagcaggggctttctttctttgccgttaatgcagacttagtctcttctgccttttgtgcaaaataaccaagaatacattctaaaataaggaaaaaataaagattaatttaaaagactatacttggaaaatatatcctcagacattaaatttctataaatgaaaggaagtagtgtattttaaagttaaagacattttcctcatgcgatgagagttgcagattttcccttattttcataattcttacaaggaagtattgctttcctcagggcaaacactaagtcgtatctttttaaagaacctggcagaaatgactagtggcagctagacagttattccattggtataccaagtgctaaagtattaaattgaccttacttccatgtgcagcccaattctgtaaggagagggaaagaaatgaaaagtgtgctgagtggtgaaaatgaactctggcctgaattaaaagcaaagggggaaatgcctagatagtaattagccctttgaccacagacaagtgtgagtgcagtaatcaggtaggcctatattgttggcaatgtgacgcaggtatatacccatttataactttctggtagcaaatagtatttgggtgtgtgttgcataacttgttcaataggtagctttgattctaataatcctttatgtccagaaacagatttatgttttctttttcttcaaatagagacagggttatgctatgttgcccaggctggtcttgaacttctggcctcaagcagtccgcccacctctgccttccaaactgttgggattacaggcataaaccacctcgcaccagacccagatttttttttttttttttcaagttaggctggagaagccaagattagcatccaatcctagtccattgctttggtgctattactttgcatttatattgtgcttgttttcctggaactcaggtgccttgtagatactatgttatattccacagttctagtatgttctttatgaaataaatacatctaagaaaatttggtcttttgaggtgaattcagaaaacattttctattaacttactgttgtgatagaattgaaatacatacgtatggaaaatttttttatatttttggaaaaattttggtaaaagtaattaagattatgtccacttttatggtatttaggacattgcaacttgtaggtctgtagtgcctgctaagagctgtagctcttagggagctaaaggttcactctttctttgcaggaagttttaaattctggtatgcatcagccaccttgtctttgtaaaatgagaatttctaccattttgggggagtctctgtcttcacattcagagcatctagaacttggcatccttcctctagctgaccagatcgttacaaagacaactaggatttgattggaatatctctctccttcaattggtgttgccattgtacatgtggtgtattctagcttcattaattcacttaaccattattgaacacattttacatacttgacatgatgcgggatcctaagagtacaaagttaaaataaaggcccctccaaagatgtataccatctaaaccaaaaattctaaaatttgaggttttggtttatgtaaatgagagcggttctgagctcagagttcagtaaggggtatttgtgtgtctatgaaagcagcaatgtagcttacttggctctgtcagtttagtccacttggacatcttggtggaacctccaaaactgttagaacgtaattttcagaaaggtaaagtcatcacttccatgcaaatgtaaatgaacatgtatcaattattttgattcagcccattgatgagggaactagtaagatgttaaagtcacttaatatgaaaatttgaggaggtatttataggcaatttaataagggaatattaagactgttgggttacatacagaattagttaataccctacaagaaacataaaagagtaggctttgggttatattttcctctggctaaaaattacttgcatctcagtgggcgtggtggctcacacctgtaatccagcactctgggaggctgaggctggtggatcaactgagtttaggagttcgtgaccagcctggccagcatggtgaaaccccgtctctactaaaaaataccaaaaattagctgggtgtggtggtgtgtgcctgtaatcccagctgctcaggaggctgaggcaggagaatcacttgaacctgctaggcagaggttgcagtgagccgagatcacaccactgcactccatcctgggcgacagagcgagactccatctcaaaaaaaaaaaaaaaattacttgcatctctatctgctgaaaagctgtaacttaatcttatagatgtgtaaaatagtcagtagaaattaataaaagattcaagcatagcactgtactgaaacacagccagtattcttttgcttattttccagttttggctagtttttatgaaaactggatatctatgtctatatccatgtatatatccatatatacccatatatagatccatatatatatgtatttgacaaagtcaccattgtcaacattgaaaattcaagggatttttaaaaaaccaatctcaagtattcattgcattacatagaaacacagagatgggctgggcgcagtggctcatgcctgtaatcccatttgggaggccaaggcgggcagattacctgaggtcaggagatcgagaccatgctggctaacacggtgaaaccccatctctactaaaaatacagaaaaaaacccaaaaaattagccgggcgtggtggcggacgcctgtagtcccagctactcgggaggctgaggcaggagaatggtatgaacccagaaggtggagcttgcagttgagccgagatcgcgccactgcactccagcatgggcgatggagtaagactctgtctcaaaaaaaaaaaataccaaaattagccaagtgtggtggtgcatgcctgtgatcccagctactcgggaggctgaggcagagaatctcttgaacatgggaggcagaggttagagtgggctgagatcgcaccactgcactccagcctgggcgacagagcgagactctgtctcaaaaaaaaaaaaaaagaaagaaagaaagaaaaagaaacacagagatagacaaataggtttatggaaaaataattttgggaatagaaatgtggtgttctttagctttttgcttgttcttaaacttttaaaatagaacctcacctagatcatttaaaaacagagagctacaaagcagagtgaaatgacactactaatggataatgcatggattgttaacattactgctaaattatgtatcttccctaaaagagcctagaacataattgccttcaccactgctccccaagatcattgaagctattgtgttacttggggaaaaaagagcatggtgtatatttgtaaatgcagtttattacctgtgtcgttgaaatcccttggtactatatgcatgtgttatttgattatatgttgagataaatcagcattcttcatatgggaaatatgcctcaaaatcattttatcagattttacagtccctgatatttattttgtagatgtcttttctgtaaggtgtttttcaccaggctagccatagaaaagaacatggctgttttcttgccagctgtagttaaaaatgtcagagaaagctagaaagaattggttgaattactttgttcctgagtccaattagattcaggttaaatatcgacctccccaccctgtgacaatttgctcttagatatctaaaaggcaagaggtgtgagagaatgtctgggttaattaatagcagtctacggcaaggaaaaagatcggtaggggctttgatttaaaaatggttttgtgaagttctactgagatcctagtgtttctgcgtttgtacaaatgtctcttggaagtttgttttagaagatggcactggatctttcctgaggcccacaagaaaagtacagggtgatctgagaaaatataactggtgtcattgatatatgagagtcaaagaagactttaagcaagcaacatttgtgcttctttctggattatatattcaaatatagtaatattactgtctccaggctggtcttgaactcctgggctcaagcgatcctcccaccttggcctccaaaaatgctgggattacaggtgtaagctacgtcgcctggctgcagacactgttcttgatacggaagatgtagcagagcccctgctgttataaagcttgtgttctaagtggctgtggcagagagacagacaataaggaagtaaacaattatctgaaagatcagtagaattaacaagaaaaaaaaagggcgggggggaaggatttgaggctgaggggaaagtaagaacatgatttgtttgtttgtttgttttgaataggtctcagattctgaatttaatgacttattttaaaaaacaagaagaataagtggatgaagctagtatggtagactgtaggtacactgagttaaggtctctgcctgagaataggaagtcctgttgggttctcatttacatagcaaagtaattagattaacttgatcagaattgctttttgaaaagattacttcaagtcaaagccaaaaactaataagagatcctgtgatttttgtgacatgagcctgttctggaattcctaaagccgctgaatgtaacagtagaactcgagggagtcatttggaattattccaaactaataatgacccaaactgacccgaagagttcagccagaactagatgagcggtaggaatgtactttaacttgctgtacttggctccctgtcagcaatgattaagtagccttctatttttggtttaattttggtatggtatatttggagcaataatattccattaaagtgttttatgctgagtattcaaagcattacctgtgttaccccttgacataaatcaactatatgtcttttgtattaaccatggactctctttcaagggaacagtaatttgattatatcctgcatatttgaatcaaaaggaattttaatgtaactagtggatttagcattatctcatgttaaaaattaacaaccaaaaattattttcttccatgggccaggtgcagtagctcatgcctgtaatcctagtactttgggaggctgagatgggaggattgcttgaggccaggagttcaagaccaacctggccaacatagcgagaccccatgtccataaaaaattattttcttcttttacataagaatatatgctagtacaaagttttttcaaatggataaagtattacacattcacattttaacatgtagaagtgaagcaacaagatgaaaataataccaagatctagatataaggactagtattagctcttctaagtaaagttttctgtactccagttttcttcctcattaggtcattttgtaaactcaaacactatttctctctctctctctttttttttttttttgacagggttttgctctgctacgcaggctggagtacagtggcatgatcatagctcactgcagcctccaactcctgggctcaaatgatcctcccactatagcctcctgagtagctgggactacaggcatgtgccactacacccagctaattttcttattttttttgtggagacaaggtcttgctatgtcctctggctggtctcaaattcctggactcaagtgatcctccagccttggcctcccaaagttctgggattacaggagtgagccacctgcctgccaaaaactacttcttacatacaaagtatattatagttctttcttaactgacctattagcagcatttgacagttgatctcttctttttttgaaatcctttcttcatttggcttccagaagaatatcaagctttcagggattttttttctctgaatattccttctagtttcccttcccttgattcctcctcatctttctgtgaccacatccttctgacctccccagagcccatttatatatatgtgtgtgtgtgtgtgtgtgtgtgtgtgtgtgtgtgtgtgtgtgtgtgtgtatatatatattttttttttttcctgagacggagtcttgctctgtcacccaggctggagtgcagtggtgcgatcttggctcactgcaacctctgcctcccaggctcaaccagttctcctgtctcagcctcccgagtagctgggattacaggcgcgcaccaccacgtctggttaatttttttttttttatatttttagtagaaatggggtttcaccatgttggccaggctggccttgaactcctgaccttgtgatctgcccgcctcggccccccaagtgttgggattacaggcgtgagccactgcgcctggccaatttttagacttctatttctattaacacatcctcctttggagatgccatcctgcctcattgcttcacgtataatctaaatctgataattaccaaatttacatttctggctcagacctctttcttaaacatgaatgttcaactctttttttgagacagggtcgcactctgtcacccaggatggagtgcagtggcaagatcacagctcactatagccttaacctcctgggctcaatgatcctcccacctcacccccctgccgcccccatatagctgggactacaggtgtgtgccaccacacccagctaattttttgtttgtttgtttgttttagatggagtctcgcttttttgccaggctggggtgtagtggtgcaatcttggctcactgcaacctccacctctcaggttcaagtgattctcctgcctcagcctcccgagtagctgggactacaggcgtgtgccaccacgcccaggtaatttttttgtatttttagtagagacggggtttcaccatgttggccaggatggtctcaatctgttgacctcgtcacctgcccgccccggcctcccaaagtactgggattacagggatgagccaccacgcccagccccaatttttaaaaaactttttgtagagacagggtcttactgtgttgcataaactggtctccaactcctgggcccaagcattcctcctgcctcagcctccaaagtgtttgagttacaggcatgaagcaccacacccggccaactttttacttgatatttccacagaggcatctcaaccaacactgtatccttttcttcccctgcaaacttgtttcttttgtagtggttaacatatcaataaatggctactccatccttccggttgctcaaactaaaaatcttaagttattcttgaatattgtctttttttataccacacatctaatttgtcagcacatccttttagctctacctcaaactatatatttagttaccgttttatactttttgacttttaccacctggaaccaagtcatcatcaccaatctcctggaatattgaaatatcttttcaactggtctctgatcatctgctcttgtcctatttagtttctttttctccccaaacacaaagagataagtgagatcatttcactcctttgttcaaaaccctctcagtgcttctcagaataaaagtcaaaaaagtcctcccaaaggtttactaggccctctgcagtctagggctgccccacctcccgcttttacctctctgacctctttaatattgtcccttgtttgttctgcttctgccccatactggctttcttgtttctataacgtagacatgttttagtcttaggacttttgtacttgctgaattttctacctgaaacacccttccctcagataatcacgtggctggcccttttacctcctttaggtctttatagtcagacatcattttcttggagagattttctcttacagcctatctaaaactgctacatcctcctgcttcccagacagtcccacatcagtgttcacagtattttttcccataaacctgtatctccaatataaatgatgtatccagttctcaagccagaaacctagtcatcattcttcccctctttctcatgccaggctaacatgtattcatcactgaatctacttgattctttctcctaaattaggagttttctaactttttttgctgtgtatccccaaaagaattttgaaaaacttgcacatttttatgctgacatctagaaattttcattttacatttaaatagttgcagtagatgtaatttcatatgtgttataaatactgatgttttaaggtaaaacagttgcatcagtcttttaaatgtgctgaatggaatttaaataccaaaataatttgatatccaccatcattttttaaaaatacacatgaaaagtgtgtctttaaaagttggaaattttacattgtcctttttttctctgtgaacttttttcattatatttcccctgcataattctaatatgatatttttagatttaagtctttaatcgcacttttttatttatactccttacaacaacaaaaaagtctacatattgaatttaaaaggattttccctacaaccgtaaagctttaaaacctgtcttttgaactgaattattattattattattattaaagtctcattctgtcacccaggctggagtacagtggcatgatcatggctcactgcagcttcaacctcccaggctcaagcgatcctcccatttcagcctcctgagtagctaggactgcaggcacatgccaccacacttggctaattttttaaaaatcttaaagatgctttctttttattttcatgggcctgtcccctcaggaggatgtatttttccactaggctagaggatggaagaggcaagatacttaaatgaaaatatttgtaattatctctttgtttagtgtctaggatttatttattgcacttcagagcaacatgtatcctatagagaatttcaagataagtgagagatctgcctttcttagtaaaatgagagggcaactgtgaaaacaggtataaaaggagaccctgctttactcactgtgtgcaggcaccttgtcaggcagatcttctttaggaaagagtacatatggctgtttagaaagtgtcctgacagacgtgggtgtttggcctgggaatttattaaacataagtgaatgaaacaaatttaatagcgatcttttcccagttcacaggggaaaaaaagcaattattttttcaattttatttttcttccataaattagaaaaaaaaatctttgttgtctgctgcaatttacttgctagtgagtagtgaaagattgtaaaataaatgagcgaatgatcatggaggttttaaagggaaaatggcttttaatactttttggtttttttcttagaaacatgttcctgtagtttgattttaagttttaaagtcattactagcattgtccctgctgtgatagaatatgagtcttaaaatttcacgttctgcaaagaacactgatttccaaatgatctgccactggaacaaattgggaaccatttttctagcctgtactgtcttgggtttacaagcaaatgacctgcctttatgggaaggtgcttctgggtcataggccattcaaagaaaactttgatgacaaaaatttttgcttcagctaatcttttttacatatttgattatattatggtaagctctcacctaatattaagtagaaatagcttcttggcctgtacttatctgcattttaaataaacttacattgtgaaagcctgctgaaagtacctaattaagagcatggactctgagaattattaatggacagtgggaggaatagagaaacgtaagagagggaattccttcatttataatgttgtatgagaaccaggtctccagatacatttccagtgaaatgaaaacaaattttatggagtttaaaattttttccagtatccagataatttcagtgaggccaagagatctgtttgctgctgtgaatctatttaacaagtatttactgagtgctttctttatgcagggtctgttctttttttttttttttttgagatggagtctcgctctgtcgcccaggctggagtgcagtggtgctatcttggctcactgcaagctctgcctcccgggttcacgccattctccttcctcagccaccctagtagctgggactacaggcgcccgccaccacgcccagctaagtttttttttttgtatttttagtagagatggggtttcaccatgttagccaggatggtctcgatctcctgacctcgtgatctgcccgcttcggcctcccaaagtgctgggattacaggcgtgagccaccgcgcctggcccaatgcagggtctgttcttttaatgacatactagattacctgtatgctaagcatacaggtgtagggaaataggaggaggagaccgaaaacaagaaatgggagctggtgtggtagtgcccacctgtagtcccagtcacaagggaggctgaggtggaaggatcacttgagcccaggagttcgaggcttaacagtgagtggtgatcacaccactgcactccagcctgggtgacagagcaagattctgtctccacacctctcccctgccccccaaaaaacaaacgagaaatggttcctgatcttaatgagtttagagtatgcagctgtggtttcaatttttaattatacactttgattagaaaaatgttgccttagaatattatattttagaattattttttaaaaccttactgggatgtaattgatataaagtatatatttacagtacatatatttacaatgtacaatttgatgttttcaacaatgtgataagttatatatacacagtaaaaccatcccagtaaagctagtagacatatccttcagccccataaatttcctcttgactgtaattctccctcctatttctccccactctcaggagacatcccaagccatcactaatctgttttctgtcattatcgattgcattttctagagttttatattaatactgatagaatcatacagtacatactcttttttttcaatctggctttcagcatgattattttagattcatttatgttgcatgtatcaatagttcattcctttttattgctcagtagtgtattccattgtgtagatatactgtggcttgtttatccattcacttatttatgtacatttagtttttcagatcttggctattcaaataaagctgctatgtatatttgtgtacaagtctttgtatgaagatatgtttcaatacaaagaatggaaattgctggtaattaccaaagagtggttggatcggatagtaggtggatgcttaacttttttttttttttgagacgaaatcttgctctgttgccaggctggagagcagtggtgtaatcctgactcacagcaacctccgcttcccgggttcaagtgattctcctgcctcagcctcctgagaagctgagattacaggcacgccccaccacgcccggctaatttttctatttttagtagagacagggtttcactgtattggccaggatggtctcgatctcttgacctcatgatccactcgtctcggcctcccaacgtgctgggattatagccatgagccaccacgcctggctgcttaactttttaagaaactttcaaactgttttctaaagtggttgtatagttttacattcccaccagcaatataagagatcctgttcctcctgccaatacttggtaatttaattttagccattctaatagcagtgtaatggtactttgtggttttagtttgcatttccctagtgattaatgatgttcaacatctttcatgtttttatttgccttccatatatcttctttggtgaagtgtttgttcagatctttggcccatttttgttgagttgttttgtttttttgtttttgtttttgtttttttttggggggatggagtcttgctctgtcgcccaggctggagtgcagtggcacaatctcagctcactgcaccctccgccttccgggttcgagcgattctttcacctcagcctcccaagtagctgggattgcaggcacccaccatcatgccctgctaatttttgtatttttagtagagacaggattttgccatgttgcccaggctgatctcaaactcttggcctcaaggaatccacccaccttggcctcccaaagtgctgggattacaggcatgagccatctcactcggccttttttttttttttttttttttccttttatcgaagtttcattatataccattctcttaatactatctttttatctttttctttctttctttttttttttttgtttttaagagatagggtcttgctgtgttgcctaggctggtcttaagctcctggcctcaaatgatcatcctgcctcagcctcccaaagttctgggactacaggcataagccactgcacctggcctatactatcttttggagaccaaaagttttttttgtttgtttgtttttgtttttgtttttttgagacagagtctcgctctgtcgcccaggctggagtgcagtggcacgatctcgattcactgcaagctctgcctccgggttcacaccattctcctgcctcagcctcccgagtagctgggactacaggcgcccgccaccacgcccagctaattttttgtatttttagtacagacggggtttcaccatgttagccaggatggtcttgatctcctgacctcgtgatccaccggcctcggcctcccaaagtgctgggattacaggcgtgagccaccgcacccggccaaaagttttaaatttttatcaatttgtttttttagggactgtgccattagtgtcatatcaaggaaatctttgcctaacccagggttacaaaaattttcccttctagaaattttttatttatttattttaattttcaaaaatagagacagggtctcactatgttgcccaggctggtctcgaactcctgatctaaagtgatcctttgtccttggcctcccaaagttttgcaattataggtgtgatccaccatacctagcctgttctagaaattttatagtttaaattttatatttatatctatgactcatttgaatcactttttcttttttaaaaaaatctcaccttgtcttatggtgctgattgaatcattttatatatggtgtgataattctgtatatggtatgtttgtttttttgtatatggatatctggttgttctgtcaccatttattgaaaaggctgtccttttcctttgctaaaggtcttcatgcttttatttaaaaaatcagttgcccatatatgtgtggttttatttctggattctctattctgttctattgattgttttccttatctttatgtcagtgccgtactgttttggttaccatagctttatagaaatccttgaaatcaggtagtgttagcccttcaactttgttcttctttagagttgtttcagttattctaggacctttgtatttccatgagaatgttttaatcaacatatcaatttctacaaaaaagcttgctggaattttgattgagattgtgttgcatctacagatcatttgggaggaattgacatcagaacaatgttgagtcttccaactcatagtttaatctcttcatttatttaagtctttaattcctatcagcagtatattgtatttttatttttatttttatttattcatgtttattgtattttgtttttattttttgatattgagtctcactctgtcacccaggctggagtgcagcagcacgatctcagctcactgcaacctctgcctcccgggttccagcgattctcctgcctcagcctccagagtagctgcccagctaatttttgtacttttagtacagacggggtttcaccatgttggccagcctggtctcaaactcctgacctcaggtaatctacctgccttggcctcccaaagtgctgggattacaggtgtgagcaaccttgctctgccagtattttgtagttttagtatatatacttcaactaaaatttttattttctttttaaattgaattttaatatttcataatgggctgggtgtcgtggctcacgtccataatcccaacactttgggaggctgaggcaggcagattacctgagctcaggagttcaagactagcctggccaacatgatgaaaccctgtctctactgaaaataccaaaattagctgggcgtgatggtgcacacctgtagtcccagctacttgggaggctgaggcaggtggatctcttgaatctgggaggtggaggttgcagtgagccaagattgctgccactgcactccagcctgggtgaaacagcgagactccatctcaaaaaaaaaaaacaaaaaaaacccaaaacatttaataatgaaaacattgccagtattcttaattgatgtttgagatatttgcatccttgtggaaatcttggcagcacaatgaagaatttggcaaaaataaatatcagtcagactctatatccaaaaggatttatttccacattgtacctgaaactcaaatgttaattactgaacaagtgcattagcaagatttttaatttaaatgtgaagatggaaaactgaaaaatataaattaggaaataacatttctataacttgtcaaatgtagtggtttatcagggtaaaaagttaaagtgcttttgtgtgtgtctacacatggatttatagtatgagactattttgttttttgtttttttttattatactttaagttttagggtacatgtgcacattgtgcaggttagttacatatgtatacatgtgccatgctggtgcgctgcacccactaacaattctatttatagtgttacagtaaggaaatgccttctggcaatttgaaaatatggtgtaactaaaatacaggtctgacttgttaatctactgttaaagactggaaattattttaattgctctttttctgactaggctttcaaaaaatatgataggcaaattggttctgtcgtggtaattttatgtttactgtctctgtagaagtgtaaagcatggttctcttccattgtcctcttgatgtcctgttacagcatttatgggtgagattttaacattgtgtgtttatttttatgactgttttcatatttgaaattaagaagtttggcataagaaactttgatgcttgatgttcaaattgctttgtagcttatttaacaaaatcataatcacagaaaaagaatccatcccagttagacattatcttaattctcatgttcaatcattttcactgagtggggcccttggctttttatggaaagatgttataagaaacaaccttgccgggcgcggtggctcacgcctgtaatcccagcactttgggaggacgaggcgggcagatcacgaggtcaggagatcaaaaccatcctagataacacagtgaaaccccgtctctactaaaaaatacaaaaaattagccgggcatggccgtgggcacctatagtcccagctactcgggaggccgaggcaggagaatggcgtgaacccgggtggcgaagcttgcagtgagctgagatcgcgccactgcactccatcctgggggacagaacaagactccgtctcaaaaaaaaaaaaaaagaaagaaagaaacaaccttgcctcagggaggggggcctgaggaggcaggaggattgtttgagccaaggagttggtgaccagctcgagcaatttaggtaggcctcatctttaaaagaaaaagaaaaaaaaaaaaaaaaagaaacggccttatgaagtctactgccacacttacaatgtaaatgtttatttatttatttaaagatggagtctcattatgtttggaagcctgaaactcctcggcccaaggaatcctcccacctcagccactagagtagctgggactacagacaccccactacgcctagttaaatgtctacttttttaaaaatgtcttttaaaagtcgattgatctattagaaatgtatggctaaaatgtaattaagttatctctggctgtgttaaagaagtgcagggtataagaggaaatatttatttctccaaaacctaatttgaatttattagaaaatatgttagaaacatatttctaacatagaaatacattagaaagcctgattttttttttttattattggtcctatatgaatttctaattgccttactgctagactttttggaccagacttcttcaaagagtagtctttccttactatggccttccacttccccattccccaattcaaaattatttttctttatcaattagtttgtattttgtcaaaattatttatgtaaataaaaagataattcgctctgcaaagcttgttatgaaaaatagcattacttcccccttaaacacaaaattttctgtttcctagagaaaaccattttaacttttcaaagtgatttatttacttctatatttctaagaaagaaaaagtgcttatattgctatttcatgtttttttctgttttggatgttatctgttgacttcctaccacggagggtaaggatttaatattctcttttttctctttttttttttttttcttggcagggactcactctgttgcccagactggagtgcagtggcacaaaggatttaatattctttaatatgcacatacattcccctccaaccacacacacactttccactttctcttcccccacttcaaagttatatcttaatttgagttggattaatattcaaagtttacattattatgactgtaaatgctatttttggggtttttttttggggtgggggggacagggtctcactctgtcggccaggctggagtgcagtggcacaatctccactcacctcaacctccacctccagggttcaagctgagattacaggcacgcaccaccaggcccagctaatttttgtatttttagtagagacggggtttcactgtgtaggccaggctggtcttgaactcctggcctcaagtgatccacccccaccttggcctcccaaagtgctgagatcataggcatgaaccaccacacccggcctataaatgctatttaatctgctttttcttttctaactcactgcttttactggagttattaattatcttgttttcttgtttgtgtgtttttctatgtagtacacttattaccaaattcaaactttttaccagttttctaaatatcctatcaagattttcatcccattgcatactctgtcaagtttgttttcttgagacagtctctcccagagccttctgacctgcaccagtgtggactggtcacctttattcctgttttacagctctcatcctataatttcctttcattttatcctgggcattcctttgacctttcttctctattgattcctttattttctttattccatatttttctttcttgattcatacccttgttttagtgtagtacaaatgacagaaggttaatgagaaagactacgtgagagataaagttttggaccttattctatctaagaatgtcacgttagcatggcgtttgatattgctggtatcttggattccaggctgaacatcattaccatctagcttctagtattactgttgaaatctgaagctaatgtctgcttctcatatataatctgctcctcctcacttccctgtcctcccagtcttgtaggatattctctttgtctccagggtcctgacattaaaattttgttcagtgacatgggcactagaaaagccctttagacttattttattgataatttcccccctcaatttcctctgtttgctagatgattctcaaacttttgaaaacctcatttatggtgaagtgtaacatataatcagaaaatgtgtaaaggataaatatacagtttaaggaacacctatttaacactcaggtaagaagacagaacattgtcagcacttttctcaggataactctccaaaaggtaaccgtttttgtggtattcactgttttgattttctttctttttgagacggagtctcgctatgttgccaggctggagtgcagtggcatgatctttgctcactgcaacctccgcctcctgggttcaagcgattctcctgcctcagcctcccgagtagctgggactacaggtgtgcaccaccatgaccagttaatttttgtatttttagtagagacggggtttcaccgtgttggccaggatggtctcgatctcttgaccttgtgatccgcctgccttggcctcccaaagtgctgggattataggcgcgagccaccgcgcctggcctgttttgattttcttaatagtttttccatctcagcgtgtatcccttaacaccattgtttaatttgttctgaatttgtttattttttatttttgtatttaattttgtctgactttgtgaatggaatcccattgtatgtattctttttatctggcttctttctgccaacattttttcagggtgcatccacattttatgtagctgtcattattactgcatttttttgactgtgtgtattccattgtattaataagccacaatttatctgtcccattctggatgaatatttgaattcttttctagttttggaaggtattattaataatgttatttatgagccttctagcgtatgtcttctggtaaacatttctctagagcattgctgtctagaagagatacaatgtgagccacacatgtaatttaaaattttccctcctaggctgggcatggtggctcatgcctgtaatcccagcactttgggaggacaaggcaggaggattgcttgagcccaggagttcaaggccagcctgggcaacacagcgagaacctgtctcaaaaatctaaataataataataataataattaattaaaaaataaataaaattttccctcctgagtgaattaatgcaggaacaaaaaaaaaacaaatgctgcatgttctcatttacgggtgagagctaaacatggggtacccatggacataaagatgttaacaacagacaccggggactaatagaggaggtagtactatgctcagtacctgggtgatgggatcatttgtaccccaaacctcagcatgacacaatatacctaggtaacaaaatctgcacatatacccccttaatctaaaataaaagttaaaaacgaaaattatcatagccacagttgaaaagtaagaagaaacagatgaagttgattttaataacatatttttaacccaatctaatcatttcagcatgtgtcataaaaattgagaatttgacttcttattttaatactgaatccttgaatctggtttgtattttacaccaacatcccatttcaactcagtggagctacatttcaggtgttcagtacccacatgaggctagcgtctattatattggactgtatagctctaaagaaatatatgtaaatctatcctgaatatatatatatatatcctatagtggaattgctcagtcatagactatacatatcttgaactttagtacttaatggcaaagtttttgaaagtgattgaaacattttacattccagtagcagtgtgtgatcgttcccattgctccacatagttaccaacatttgatattatcagaatttttagttttgctgcctggtgagtggatagttttcatggtcgtttaatttacatttttctgattacttaagagctagagcactttttaatatatatataggctatttgaatttattcttttgtgaagtgctagtttaagggttttttgcccattttttctcttgggatttttatcattttttttcttactgaatttttaggagttctctatatattctagatatgagccttttgttacatgtactacatatatcttctccaactctgtaacttgcctttttactttcttaaagatgtcttttgagaaacctaaattttaaagtttaatataaagtttatcagttctttccttcatagctagtaattttttgtgtcctatataagaaatctttttcaatcctgaaatcatgaagatattatctagttttacactgtcagagctttattgggtatatttatttattaggcctaacatgcagctaggattgatttttgggtaaaggttgaagtaggagttgattttctttttctgcagtggttcaacactattcatacacttccctgcctccctgcaactctctgccacacctcatactctacagtgccatctgtgtaaataagcgtctatatatatgtggacttgtttgtggactctgttatgtcccattgatttctttctctatccttatgccattgtcacattcttcattactatagctttgtaataaatcctgacaaccattggagcaaatccttgtacttccttacagacatatgactttgttgttagtaattttaaaaaaagaatatatgactgattttcttagctttttgcacttttatttacatgttgaaattatcttggcatttttagcaaaacaacctgcttggatttgattgtgattttataactgcatgtatcaattttgagagaattcagttgtatacaatattaagtctgacagttcaccaacatggtatcatctttcatttatttagctctttaatttttcttaaagtctagttttctccctaggagtcatgtgtaccttatcaggtactcaaggtacacggtattttaaattctactgtaaatgctatttaatttttttttttttgagacaaggtctcactctcacccaagctggagtgcagtggcataatcatggctcactgcagcctcgacctccgggttcaggtgatcctcccacatcagcctcccgtgtagctgggactacagttgcgtgccaccacatctggctaattttttgtagaagtggtgtttcaccgtgttgcccagactggtcttgaactcctgggctcgagcgatcctcccgcctcagcttcccaaagtgctgggattacaggagtgagccaccgcacctggcctaaaaattttgtttgctagctttgttgctggtacatagaaagaaaagtttattttttatgagttcaggtaatttatgtgtacaatatttttgtcctgcatgggtacattattttgtcctccatgggtgcatggattcttcagagaagcagaaccaataggagacacacacacacacacacacacacacacacacacacacacacacacacgacatttaaggaaataggctcatgaggttatggtggcccagaagtccaagatctgcatttgtcaagctgcagacccagaaaagccaatggtataattctagtcctagtctgaaggcctgagaaccagaagagctgatgatataaattccagtctgagtatcagtctgaaggcagaagaccggtgtcccagctcaaatacagtcaggcagagagaaagaattctttctcagccttttgttctattcaggcctttagtcaagtggataaggccacactggggagggtagtctgcttttctcagtctaccaactcaaatgttaatctcctccagagataccctgacagacatacccagaaatagtgtgtaaccagttatatgggcaccccaaaattaaccatcacaatgggcagtcagatgatctgcaaatttgtttcttctttaccaattctgaaattttctttttcttggtttactgcaatagccaggacctccaaatataatgtggaatagaaatgataatagaaaatatccttttccttgatctccaaaggaaagctgtcagtgtcttgtcttactattaactatgattttattgtagctttttttgttttgttttgttttttctttgagatggagtcttgctctgtcgctcaggctggagtgcggtggcatgatctcagctcactgcaacctctgcttcccagttcaagcgattcttctgcctcagcctcccgagtagctgggactacaggcacctgccaccacaccggctaatttttgtatttttagtagaggcggggtttcaccgtattggccagggtggtctcaaactctgaccttgtgatccccccgtctcagcctcccaaagtgctgggattacaggtctgagccaccgcacccagcctattgtagctttttagtatacatcctttatcaaatgaaagaagttcacaaagagattttttatttgtttgtttgagacagagtctcactctcacccaggctggagtgcaacagcacgttatctcggctcactgcaacctccgcctcccgggttcaagcgattctcctgcctcagcctcccaagtatctgggactacacgcgccttctaccatgcgtggctaattttttgtatttttagtagagatgggatttcaccatgttggccaggctggccttgaactcctgacctcaagtgatccacccgcctcggcctcctaaagtgctgggattataggtgtgagcctccgtgccgggcccacaaagagattttatcatgaatgaatgttgaatatttttcaaatggcttttttacatatatattgggatggtcatattatttttctttttttcttttcttttttttttttttgagatggagtctcgctcagtcatccaggctggattgcagtgatctcagctcacggcagcgtctgtctcccgggttcaagcagttctcctgccttagccacccaagtagctaagattacaagcctgtgccaccacacctagctgatttttttatttttagtagagacggggtttcaccaggttgtccagtctggtctcgaactcccgacctcagatgatccacccacttccagcctcccaaagtgctgggattacgagccaccatgcctggctgtgattgtataatcttatttgtatacattatggaatttagttaggtgacactttacttaggcttttttttttttctggattcataagtgaaaatggcctataattttgttttcttttagagatgaggtcttgctcattcccccaggctggagcgcagtggcaccatcatgtctcactgtagccttgaccttctgggctcaagtaatccttttgctttagccttctgagtagctgggactacaggcatatgccaccatgcccagctaatttttttattttggagagatgaggtcttgccatgttgcccaggctggtctggaattcctggcctcaagcgatcctctgaccttggcctcccaaagtgctgggattacaggcatgaaccactgtgctgagctaaaaatggcctataattttcatctttctttttgagtttttatataaagtctagtcccaaaataaattggagagtatctttttaaaaaaaattttctaaatgttcgcttaagattgttgtattgcttcctttatgtttgatgagtttgtcaatgaagccaggtagacccatataatgggctataatgcaagtctcaacaaatttcaaaagattgaaatcatagaaaatatgttttctggccaggcatggtggctcatgcctgtaatcccagcattttgggaggcagaggtgagtggatagcttgagctcacaagttcaagaccagcttgaggtcaaggctacagtgagccatgattgcactactgcattccaacgtgggtggcagaatgagactctgtctcaaaaaaattaaataactaaataaaaatgaaaaagaaagtatgttttctgacgacgtgattattatagaaatcaattttaaaaaccttttaaaaaatctcatgtttaaaaattaaagaaatttgcttctagattcttaaggtgaaagaagaaaccataatggaaattagaaactatagtccaccattcttatccttgggttcttaatccatagattcagccaacctcagatcaacagtatttgggaaaataatggatggttgcatttgtactgaacacatacagacttttctcttgtcattatttcctaaacaatacaatataaccactattacatagcatttacattgtattaggtgttacaagtaacctatagatgatttaaagtatatgggaggatgtgtgtaggttgtatacagtgttacaccattatatataaaggacttgggcatccatggatttgggtatccacaggtgtcctggaactaatttcccacagacactgaaggatgactgtattttgaactggatgattacaaaaatattccatatgaaaatatgtgtgtttttacaaaagtagttttagagaaaacatacatattagaaaagaaaggttgacaaaaatgagcaaagtatccatctcaagaagttggcaaaagaacataaaaagcagaagaaataatgaagataaagcaaaaataaatgaaatataaaacaaacataaaataggatcataaaagccaaaagttggttctttaaaagattaataacattgataaacctctgagatgctgatcaagaaaagaacgaatacacaaataactaatattagaaatgaaagaagggatttttactataaatcctatagacttacaaaatatgaggctataatgcacaattttatgctatttttttttttttttgagatggagttgcccaggctggagtgcagtggtgcgatctctgctcactgcaacctctgcctcccaggttcaagcaatcctcctgcctcagcctccttagtagctgggattacagacacgtgccaccacacccagctaattttgtatttttagtttcaccatgttggccaggctggtctcaaacttctgacctcaggtgatccacccacctcggcctcccaaagtgctgggattacaggtgttagccaccgtgcctatgctaattttttaaaactctcattttgttcaggcatggatctcttaggaaatggcaaagtctaaatcgtagactaatcattgtttggcaatggttggtttagtggtggcacgtgatgtgatgttaggaagaattctatggtaaattttgagacttcaaataaaatggttaacttcaatgctgtgttttttgtggggagggttttaaattacttttgcttaactatgaggctattcaagttatctatttttgtgttagtgcttctgatatccttctgacttcatggcataaaaagttaaagcaggctgggtgcagtggctcatgctataatctcagcactttgggaagctgaggtgggaggatcacttgagcccaggagttcaagatcagcctgggcaacatggtgagacttcatctctacaaaaagttttaaaaattagccaggtcatggtggcacacacctgtagtgccagctacttgggagactgaggtgggagggttgcttgaccccaggtctgcagtgagcctgggtgacagagtgagaccctgtctcaaaaaaagaaaagaaaggaaagcaatacttttttaaatttctttcaacaaatatttataggacacctactgtatgctaggtactattatttaccatatttcttatatccagtcagactggattattatttaggacagaaaatttagaaacaaaaacggctcatccctagaaggatgcagctgcttaaaaaaaaaaagaaagaaaaaaaaagaaaaaaaggtggggtgcttagcatagctggtggtgacagtgctattgtgaaagctgagtagcacctatttcacagagcacctctataatttgtaaaggagtatggtttttcagatgttacctttattactgggattcatgacctgcgtagacttcaagtaggtttattgacttcagggtatccacagttcctctgaaattgtatagaatagtttatgtgtatatgctttttggtgatagggaagagagggttcaatggctttccatagatttttcaaagggtccaaaaatgcttaagaaccactgctctgtgggttaagaaaagtttacagagaccaacaaatagtttttttcttcattttgtgttttatgtctgttttgagtaaccattatagtaaaatattatatataagattctctttgacttttgttcaatttatattattttgccattactttaactgataacttttttttaaaggttcaggaacaagtgcatcccactctctcagctaatgaagagtctctctattatattgaagagctgatttttcagctgcttaataaattatgcatggcccagccaaggactgttcaagatgtagaggtaaaaattattttgtcatttcaaaaagtcactcaaccactgtatgaattaatttttgtatctatatcattctaatttattgtgaaaactaaaaccactgaaattatgtatgatatatatggtcagtttgtttttgacaaaaatgtcaaggcagttcattgaggaaaggcaagtttttcagaaaaaaaaaaacttagaacaactgggtacatttatgaggggaaaaaaccttgaaacctatctcatgccgtagacaaaaattaattcaaaatggatcatggccttagacataacagctaaactacaaggtttctagaagaaaattctggaaaatatcttcataacctgggtttaggcacatattttttagagaggactcaaaacatagtactttatattgaataataaggccaggtgcggtggctcacacctgtaatcccagtactttggctgaggcgggagaccgtctcaaaaaaaaaaaacaaaaaaaaaatgttctctatgtcagttgagatgatggttacacagacataagcatttctaaaactcaacaaattgtacattttaagatctgtgtattttactgcatataaatattacctcaataaaagattagtgtaaattttgaggacatttgctcagtgatttaaaaaaatgtatatgtatgtgtgtgtgtatatatatatatatatctgaaaaactgtttaaattagtactaaaataattgttttgccttggttacatgggagtatttttggatttttagcaatatctgttagggagagttttacttcttttgtataaaagcaccctgtgcacataaaattaatattaataaaattggtattattttctcctgctaaaaacaaatgtctaatagtacagctatcaaaaattattttcatttttattttttgagatggagtctcactctgtcgcccgggctggggtacagtggtgtgatcttggctcactgcaacctcagctacccaggttcaagctattctcctgcctcagcctcccaagcagctgggactacaggcgtgcaccccaggctaatttttatattttcaaaaattacttttatactatactgtttacatttcctttttttttgaaatttgtttctataagcaacaactttctttctttctttttgtgaagtggcatgatcatagctcactgtagccttgaactcctgggcccaagttgtcctccagcctcagcctcccgagtagctgggactacaggcacgtgtcactgcgcccagctaatttttatttttatttttgtaaagactgggccttgccgtgttgcccaggctggtcttgaactcctggccttcagtgatcctccctcctcagccttccaaagtgctgggatacaggtgttagccaccatgcccagctacaacaactttcagtataaaggaaaatcttaatttgtagtgattgagctattaagattttccaggattcttggaattaaagcatttttttcccctgttctctgctgccaattgtttgggttttgttgtgttttgttttaagagacagggtcttgctttatcacccagactagggtgtagtgacaggatcatagctcactgtagccttgaactcctgggatcaagcagttctcctgcctcagccttccaagtagctgggactacaagtgcatgcaaccatgcctggctaatttttaaatttttttgtagagacagggtctccctacattgcgcatgctggtttcatactcctggcctcaagggatcctcccacctcagtctcccaaagtgctgagacttagaggcatgggccaccatgcccagcctctgctactagttttgaacatgaaataaacagactgaaagcatatttttcaatagctaaatttgctaaaatctgagactataactataaatataggaaaccctgctaaattagagtttaattcagatctcagtagttcttgtttttcatgccaatgaatcactgattaaattaaaattagatgaactgcctaggtgcagtggctcacacttgtaatcccagcactttgggaagttgaggtggacacaatcacttgagcccaggaatttgagactagcctgggcaacatggcaaaactctgtctctacaaaaaatagaaaaattagccaagagtaggggtatgtgcttgtagtcccagctactcgggatgctgaggtgggaggatcattggagtctgggaagtggaggttgcagtgagctgagatcccgccactgcacttgcacttcagccagaagtgacacagacagagtgacaagagtgagaccctgtctccaaaaacaaaaaagcaagatgaacacaaaggctaagattgtttttgtcaaggtacgtattttcataagccattctgagctctctcacccatttcatcttccaagagatacatgacctcttttatttgaagctctaagattaacgaaaggagagtggctgtatactaatgattaaaaatgaatgaacaatttctgctctgctaggtaaatagttttaactctagaaacctaacttaaaatcactaatacactatttcatgttcgctttaatctttcttatatatcctatgtattgttttttcctttttccggttcatcttaattatgtttaaagctttctttttgaagtttacctttttgttttatccatgaaaattatgtggaaaaattttgatagtcctgttgacctttttttttttttttttttctgttgggggtctccctctcacccaggctggagtgcagtggcatgatctcggcttgctgcaacctccgcctcctgggttcaagcaatcctcccacctcagcttctgaagtagctgggactataggcatgcaccaccaccatgccgggctaatttttgtatttttaatagagatggggtttcaccgtgttgcctggctggtctaaactcctgagctcaagtgatccacctgcctcagcctcccaaagtgttgggattacagacgtgagccaccgcgcccagcctgaccttttttttaagccaaaaaatttatttattacaggaatcagaatgtattgtgtcactattatctgctagcattaagaatagagatcaagttgaattttgtatgaatttcctatttatgaacacttttattaatactacaatggttctgctgtgattgagcaggagcgagttcagaagacctttcctcacccaattgataaatgggccattgctgatgcacaatctgctatagaaaaacgaaaacgaagaaatcctcttttactgcctgtggacaaaatccatccttcgttgaaggtaacaaaagattaaacattagttggggggtgttctttataacaagtaatattttatttctatatttataaagcattaatgtagcatggtctgtgttagtgtgtatatgtgcacttccatatgtatgcttgtacatacacatcgcatatattaatatgtatacaaaatgattatgctctggtgaaattggattgcttttcaaacaatattaaaaattattaatagtgataatgcattactattattttgtggcatcttttttttttttaagtagagacagggtcttgctgtgttgcccaggctggtctcaaactcctgggctcaagtgatccacctacttggcctcccaaagtgctaggataagagtcatgagccatcaggcctggcccattgtggcatctttatggcatcttccaatgactgctactctgactaattcctatgtagtaggccatgattctcagtcatttgttgattaagaaagtgtataatttcagaagctactgtgagttcagaactgtctttaaaattaatttatattatcacagattattttttatatactggaaaagtggactaggacctagtttggctattgcatattaacgcatagggcaaaatatgtttggtgtatatggattttaagagttttgtagcaaattcaagccccccccgccccgcctgcctcacacacacagacacttccatacctcccctcagtagaaactactgtaattaggggatactggttttaaagcagagtccttgaagatagcagatattttgatatttgtcagatgaattttggttaatgtattaagaggcttttagtggagtccaacccaagatttctatatcaagatcaactgttgttgtttgataaaaggcagagttgttagattagatgtctcttaaaagaaaaaaaatcccctaatacagggaccaaagattcattttatatcccgtggtacccatacatttagacatgtagttaatagaaaattttttataagcaaggatgttaaataggaattttttaagtgtgtaatacttgacagtgctacattttgcaattaaattatttattcttttcacaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggtaagtgttacaaggtatttaaatttaacttgaatagcaactatactaatttctgcctcaatctttttgtgtacattattagataagtaatctttataattgctagtactggaagagagaaaaatcctggctttacagagtaaccgtgatatttccaggtttttaagcatatggcaggatggggatctctttttttggtcaagaatcttttacttacaagaaaaaaaacatccaaggcctcaaaacaatttaagtagtttcagttttatatttttagaaagagaatatatagagttctactcaggtacttttaagtgtaagtaattttgaagaccctactttggtttcacagcatagcttagtgaggcacaggggagagaaaattagactgcaatgttgaagttactcccctctgatcatttttttgtttttatatctgtcttctttcctggctgtaagctacttgtgggaagaaattgagtcttccatattcttctatattcctttacttaccttcttattcttcttcctgttatttgagacaaggtctcactttgtcacccaggctggagtgcagtggcacaatctcagctcactgcaaactttgcctccctggctcaagcgatcctcctatctcagcctctcgagtagctaggaccacaggcgtgcatcaccacgtccagctgtttttatattttttggagagatagggtttcaccatgttgcccaggctggtcttgaactcctgagctcaagtgcttgcctcagcctcccaaagtgttgggattataggcatgagccactgcacccactgaagctataacgctgaataacatagcaatctttgtgttagaaggtatttattttactgcaaaataaaaatattataaacagataattacagaacaatatgattaaaactatcatactagtaagtccaaggtacagtggagaaagtaatgaactttagcacgggtgaggccagaaagactacagagaaaatgcctaaatgaaactctctcagggtgaacaaccttcaggacctagcacatgctggtggttctcagccttgactgcacatcagaattaatagaaagctttttaaagaatgctgatgcctgcatatcacccccagagatttaattggcctggattggatctccaaacctcagtgttctttgaaagcattccaggtaattctgatgtgcagttataatgactgagaccgattgtacgatgccataatttcagaaatgacttttcacttacatcatggtagcaattccttgttatctctattttgacttacaaaattatggctactttttttttttttttactttgaaaatatcttagacttttagaaaagttggaagtacaacaaaaagtaagcccttgccacttgaaccatatgagagtaagttgccaatatagtatgtcctataaacaagaacattctgctacattaccacagtatgactgacagtcaaaatccaggaaatgaatacatttgatacattataccatctaactttcaaacatcattcaagttttgtcacatatcctaatgatctttttaccaaaatcattcattccagaatcatatattgtttatgtgtcatgtatttttatcgtcttcagtctggaataattcctcattcctcccttaacttcaaaaaaaaaaaaaaaaagatggcaaagcaggccaggtggtggatcacgcccgtaatcccagcactttgggaggctgaggcgggcaggtcacttaaggtcaggagttcaaaccagcctagtcaacatggcaaaaccccgtctctactaaaaatacaaaaaaagtagctgggcatggtggcatatgcctgtaatcctagctgcttgggaggctgaggcacgagaatcatttgaacccaggaggtagagtttgcactgagttgagattgcaccactgcattgcagcctgggtgacaaagcaagactgtttcaaaaaaaaaaaaaaaaaaaggtggtaaagctgactttattcaagagaggccatggcaataggcacagggaccactgcagtgtaatcctgtggttggggagagagatgttagaatcaactctcctcccttaacttctataacctggacgcttttgagagttacaggtcagttactgtgtagaatgtccctcaatttcggttttctctgttgttttctcttggttagaatcaggtaatggtctttagcaggaatatcatagaaattgtgctgtgttcttctcattgcattttctcagatggcacacaggcacatgatttcattgtgtctcattagtggtggtgatgttgacttcgatgacttgattaaggagttatctgccaggcttttcatctgtgaagttactgttttcccttttgtaattaataaatgaatattttgtggagtactttgaaactgtgtatcttattctttatcacactcaaatttaatatggactaatgaattgttattttattcaatgggtcataatctgttacttcattatttagatgttgtaggccaggcaccgtggctcatgcctgtaatcccagcactttgggaggctgagacaggtggatcgcttgagctcaggagttggagaccagcctgggcaacatgtctctacaaataaaaaaaattatccgggcgtgtgcttgtgactatagtcccagctatttgggaggctgaggtgggagaatcactggagctcgggaggttgaggctacatggaatcgagatcacgccactgcacaccagcctaggtgacagagtgagacactgtctcaaacaaaaaaaagttccggttgttccagatttggttattaggagccctagcttggtttttctgttcctgtcattatttgagcactttattttcttttccccttcctatttattaatttatttaattataaattgacaaattatagttgtatatatttatggagtacaaggtaatgttatgattacaaagaaaatgtggaataattaaatcaagctgattaacatttattacctcaaatacttattttttgtggtgagaacatttgaaatttactcttagctagtagaatgatggttacaaggctaggaaaggtagctggagtgggggaaatggggatggttaatgggtacaaaaatattgttagaatgaatgagatctagtatttgatagcacaacagggtgactacagtcaacgataatttgttgtatattttacaacaattaaaagagtttaattggattgtttgtaacacaaaaaaaggataaatgcttgaggtgatggagactccattttattctgatgtgtgcattatatgcctgcatttaccccatacatatatacacctactatgtacccacaaaaatttcttttaaaaattgaaatgacaaaaaaatttactctttttgcaattttgaaatgtaaatacattattatttactatattcaccatactgtgcaataaatcttacaaaaaagacccaattcctcctaattgaggttttgtcccccttcccttcagcctctggtaaccacattctactctgcctctatgagtttgttccagattccacatgtaagtgaaaacacatatgcattttctttgttgtttgttttttgtttttgttttttttcttttttgagacggagtctcactctgtcgcccaggttggagtgcagtggtgtgatctcggctcactgcaacctccgcctcccaggttcaagcaattctcctgcctcagcctcccaggtagctggaactacaagtgcccaccaccatgcctggctgatttttgtgtttttagtagacggggtttcactatgttggccaggctggtctcgaactcctgaccttgtgatctgcctgcctcggccttccaaagtgctgggattacaggcttgagccaccacacccagcttctttgtttttgagagcttgagtctccctctgtcacccaggctcactgcagcttcaaacccctgggctcaggcaatcctcctgcctcagcctcacaagtagctagagctataggtgcctgccaccatgcccagctaatttctaaattcttgtaggaatggggtcttgctatgttgcccaggctggtctggaattcctggcttctagtgattttcttgcctcaacctcccaagatgctgggattacaggtgttggccactgcaccaggccataaactatttttttttaataagtcattcctttatttgaagcatttttccatgtcctaaatcttcaccttttgagagtttaaaaaaatcttcatgtggcaggattttcagatccccttgttatattgcttttagactgatttctaaaactgtgaagacaatagtccagatttggtctgaccaacagagtatattgaaatgcatgtacgtatccttcattctatatgctattctttaataatttcagcattaatattttggcaccacgttactctgtgtacttgttgagtctgcagatttctaaactcccgaggactgttccacatgaagtaccattatgttaggtctttgatttctccaacttgtgcttgttgattttttgttattgttgtaagaatgaacgtgaatttatccctagaaaacttcatactgttattgaggctatgttccagcatatgtagatattttaaaaattgaattctgtcattcagcattttagatactctacccaggtttttgtaaagtgtacaagtctgataaaccttgaattaaaattatttagtaaaaatgttgaaaaggccaggtgcctttgaatctgagaggcggaggttgcagtgagccgagatcacgccactgcactccggcctgggtgacagagcgagactccatattattttatttaatttatttattttttattgttgagacagagtcttgctctgtcacccagtatggagcgcagtggcgtgatcttggctcactgcaacctctgcctcccagtttcaagcaattctcctgcctcagcctctcaagtagctgggataacaggtgcctgccaccatgcctggctaatatttttgtatttttagtggagatgggattttaccatgttggacaggtgggtctcaaactcctgacctcaggtgatctatccacctcagcctcccaaaatgctgggattacaggtgtaagcccccgcgcccagccaatactccatcttaaaaaaaaaaaaaaaaaaaaaaaaaaattgaaagggattatataagaaatgagatttccaacatatgttattagtggcattcttctaggttaaaagttaccacttttcttcattcctgccttttagttagctattatttcacattttatttaattcatgggtcaacaaactttacctataaagggccaggggataaatattttaggctttgtgggccatacgtctttcttgcatctactcttctctgctcttgtagcatgaaagcagccataaatgaatgagcatgggctatgttccagcaaaactttatttacaaaaacaggctgcaggctggatttggcctgtagtttgctggtccttgtttcagacattcctgtcatgatcccctatttgtcacaagagactgtcatatgcttagctaaaatccagatgacttggccgggcgtggtggctcacacctgtaatcctagcactttgggaggccaagacgggcagattgtctgagctcaggagtttgagaccagcctgggcaacatggtgaaaccccatctctactaaaatacaaaaaatcgtccagacgtggtggcgattgcctataatcccagctactcaggaggctgaggcacaagaattgcttgaacctgggaggcggaggttgcagtgagccgagtaccacttaactccagcctgggcaacaaagtgaaactatgtctcaaaaaaaaaaaaaatcccgatgacttgatatgtgggtctagttatgtaaccctaagtaatgagattgtatgatgtggtatgatcttagtatatccaaactgatatctagagatcactagttcaagagctcacagaccatttgtttaataaattatttgaatatatggtttctagggatatctttaatttgccagacagagaacttgagaatcaaccctatttctttacagttaaaaataaaaataacatgtggctatatgaggtattctagcatatcaaagattgctgagaattagatgatcataggaaagaaccatagaatttaacttctagtatataagttactactaatgaaaatagtatttaaaactggaaaaactgaacataaatgcttaagaaggaaattgatgtttaggaaaggtaaaggccaggcacagtggttcacgcttgtaatcccagcacttttggaggttgaggcaggaggatagatggagcccaggagtttgagaccagcctgggtagcatagcaagacatcatctctacaaaaaatttaaaaaaagaaacaaagaaagaaaggtgagataccctggggaatatagcaagacctcatctctactaaaaataaaaaaaatattagctgggtgtggtggtgcatcccagctacttggaaggctgaggtgggaggattgtttgagcctaggacattgaggctatagtgagctattattgtgccattgggcaacagtggacaaaaaaaaccaaaaaaaaggtgagagaataagagggcacaaagctgctctgaggaagcttagttcaccagatctagatatactagcagttgagttctgtattttctttcttttgtttttaacctattgaattatacttttttttttccttctgagacagactctcactctctcaaccaggctggagtataatggcgtgatcttggctcactgcaacctctgcctcctgggttcaatccattctcctgcctcagccttctgagtagctgggattacaggcacttgccaccacgcctggctaatttttgtatttttagtaaagacagggttttgccgtgttggccaggctggtctcgaactcctgacctcaagtgatctgcctgccttggcctcccaaagtgctaggattacaggcatgagctactgcgcctggcctttgtttttgtttttgtttttttttaaagacaaggtcttgctctttcgcccaggctggagtgtagtggcgcaatctctgcccagtgcaacctctgcctcccgtgttcaagcgattctcccacatcagcctcctgagtagctgggattacaggtgcgtgctaccatgcctggctaattttttgtacttttagtagagacagggtttcgccatgttgggcaggctggtcttgaactcctgacctcaggtgatccatccaccttggcctctaaagttctgggattataggcgtgagccacccatgcctggccagaaaaatctgaagctaacaggagtggggtatgaatatattttctctttcatggtagtattactccatctgtttcaagagctagcttgctcgctcctttttttttttttttttttttttttttttttttgtgacaaggactcacctaagccggagtacggtggtgtgaacacggctcactgcagcctcaacctccagagctcaagtgatcctcatgccttagcttcctttgtagctgggaccacaggcttgaaccaccatgcctggctgtgtttaaaatttttttgtagaaactgggtctctctttgttgcccaggctggtcttgaactcctgggctcaagcaatcctcccagtttcagactggtgaccttctagtgaatagggtctctaggtttgttttttaaatttttgaattatttgccatccatttatatttacagatctaaaaattttacataaaaatgtaaatcccagacttttcatgaaaaaagaaaatcagaatgcctaacagaaaacagctggcactgagcagcacacttcctctttaggtgcatgtaccttccggtttaccataatccccactgtttcttatatattataatgttacttgcctgacccctgtagcatttaaattcaggaactttggtattatgtgaccaaaagagttttaagaatggaactctggagtgggtggtagagaaggtaagtcatagaggaggccccactgacagaatggtgtatcagaagccaagaagagaaaaattgtttggagctggggggtttatatgtgttttttcttatttagagataggatctcattctgtcactcaggctagaatgtggtggtacaatattagctcactgcagcttcgaattcctgggctcaagtgattctcccacctcagccttcagagtagttaggaccgcaggtgtctaccagcatacctggttattatttttttttacttttggtagagatagaatcttgctatattgcccaggctggtcttgaatgcctggcctcaagtgatcctcctgcctcggcctcccaaagtgctgagattgtaagcatgagccaccatgcctcgccctgagagttttaagagttttaagaatgagagaatggtcagctgtgtcaaaaactagagaaaacaagtaggaagactaaaacacaccattagatttgacactagatcaatagtgagagcagttttaatatagtaatgggcttgctaagtgaatgggagcaagaagttacagctagcaagtatgacctactctaaaagggtctctggtggggaagagaagagggtggtagctcttctgtgtgtttttatgtcttatgtcttcctttattttgcatgtctgtttgaaatcagagttcatcaccaaattccctgtgtagccttactggtttctttaaatttaaagtggctgggaagtggggatgatggtctccaatgacaagaaggtggattgcatggagtaagcagtggggaagggagggatttgagagtgtcacagaacatgagattaggaaggtgggttggagttaaattatgaatggcctttatcctaaagaagttaggattttatgcagaaggcaatgaaatccagtatcatttttatgtatcatttatttttagtaacatgattttagaactggggttgggaagacctgtggcaggcagatcaaattatgaaacttgtgtatctttttaagagatggtgattgtttagtggagtaatctaaagcctgcggtaagatggagagagctgaccagatttaaaagatgcttataagatatttctgagttagattcaaaaagattaggaaggcagagttcatgtttactttattagcatattttaccaacatgtggtacagtttatggtgatcagtagatgtttttcagaatgaatgaatgaatatctgttattgtgttgtcagaatttcctctcatccctttgaagtttttactttttgtagtttccttttcagggtatacctttatgctgaactctctgggtacgtttcggtcagtcttaaatatataattaactaggtccaatcattttttttaaaaaaaagtattattaattataaaatgtatggtcacagccaggcgcagtggctcacacctgtaatcccagcactttgggaggctgaggcaggtggatcacttgaagtcagaagctcgagaccagcctgaataacatggtgaaaccccgtctctattaaaaatacaaaaaaaaattagccaggcatggtggcgtgcacctgtaatcccagctactcaggaggctgaggcaggagaatcacttgaacttgggaggcggaggttgcagtgagctgagatcatgccactgtactccagcctgggtgagagagcaagactgtgtctcacaaaaaaaaaaaaaataaaaaataaagtatagtcaactttctttttcactttgatttatagctagttcttgcctgttggttgacctaagtccatggtagcatttctgaaagaagaagtggttgctacaacaatttaagcatctgtgagatgtttgggtttagcaaatgaacgtaatagcagtggtcattgtagtaaatgtgcatcagaaatgcatcgcactgatctatcgtgtgcctctaccatagtagcatttcacttttctccttttaaccctactcaaatatgtactgtcatccttataatatggcaaggaactaccatgttgaatacctactatttgctagatgtagtagtatgcattttatatacattaccacattgaattcttcttatcagctacattttactcataaggaatgtgactttcaaaagaataaatgtgttcataatcatagtcgagtagtggctgaactgggatttttggctcgggttattgttccccaaagacaggcttgctttttttttttttttttgctattatgtgtgtgtgtgtgtgtgtattacagtatacatatatacatatacatatgtattagtacatatttcaccattagttcatatctccagaaatatttattttgccatactcgattttatttgaatatttcccaccttcaacaactttttttccttttattctaggttttatcatataaatttacttataatacacacaactcattgtgtaatatttgtgtgtgcgtgtgtgtgtgtgtgtgtgtgtgtgtgtgtgtgtgtgtgtgatggagtctcgctctgtcgcccaggctggagtgcagtggtgtgatcatgactcaactgcagccttgacctcccaggctcaagcaattctcctgcctcagcctcccaaatagctgggattacaagcgcctaccatgacgcctggctaattttttgtatttttggtcgagacagggtttcaccatgttggccaggctggccttgaactcctgacctcaagtgatcctcctgccttggcctcccaaagtgctgggattacaacacccagccctgtttaataacgtatagatttcaagtactttgaggcagtttttataaaagtaaagaaaataaatttatacattattgatttctgtttctcaggttttgatggacatgtttgatcaggatgacataggtttggtttctctctgtgaagatgaacgtagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgtaagtacctttttgggtttgaaattctgtgtaccccaaaaaaccagaccagcttaaaatcataaatagtcacttttttttatttttttgagacggagtcttgctctgttgcccaggctggagtgcagtggcgtgatctcagctcgcaccactgcagcctccacctcccgggttcaagcaattcctgcctcagcctcctgagtagctgggattagaggcatgcaccaccacaatcggctaatttttttatatttttagtagagatggggtttcttcatattggccaggctggtctcaaactgccgacctcaagtgatccacctgccttggcctcgcaaagtgctgggattatacgcatgatccactgcacccagcccataaatagtaactttaaatactttatgagtacattaaaaatactttcatgtatttgtgggctttataaacatgtgaattgttatataataggtacagtgacaatgaaaattaggcacaaaattagaaggaggtttatactggggtgaaatcattttccgttatgcagttctgatatttagagtcattcatttggaggtggtgaaaaagatgtatggtctaggaaaggaagacctctgcatttttctgtcttttggtaagtaccttaaggcagtagtttaaagttttagtttgaagctcagaataccatggggttaaaaaaaataaagttttaacggtggaacttttaaaaataaaagtttatgcagaatgccatgtttaacaaacaaaaaagttttttttctttcttttatcacatgatttatttttccatgtctatgtgtttggcccacactttaaaaataattagtcttgaccgggtgcagtggctcacgcctataatcccagcactttgggaggccaaggcaggcagatcacgtggtcaggagatcgagaccatcctggctaacacggtgaaaccccgtctccactaaaaaatacaaaaaagttagccgggcgtagtggtgggcgcctgtagtcccagctactccggaggctgaggcaggagaatggcgtgaacctgggaggcagagcttgcagtgagccgagatcacgccactgcactccagcctgggcgacagagcgagacttcttctcaaaaaaaaaaaaaaaaaaaagtaacaataataataataataataattagtcttggccaggtgcagtggctcatgcctgtaatctcagctgttttgggaacctgagacaggaggattgcttgaggccaagaatttgagaccagcctgggtaacagagcaagacccagtctctacaaaaaaatttaaaatttagctgggcatgatggcacatgcctgtaatcccagctgctggggaggctgaagtgagagatttgcttgagccaggaatttgagactatagtgagccatgatcgtgccactgcactccagcctgggcaaaagagcaagacctcggctcaaaaaaaagatacttagcctttgtcttatttatcttgtacctcctaacttcctccacaaaataactacatcgtgagtaaataagagtgacactcagacacaggtggttgagtatttaaagttaggaacagatttagcttttctcattatattccaaaagaatgagttttaaatgataatcgaaagtgttttagttggcaattactttttttcttttggatatatgtttagtttaacaatgtttataataactcctactgggaatactatcataagtagtcagaactttatgtttttcaaagtactgttctattttatttgacccttataacaatcctgagggatagaatgggcaaatattgtcatctctactttacttgtaaggagattgactttttttttttttttttaaatatagatgggggtcttgctatgttgttcaggttggtcttgaactcctgggcttaagcagtcttccttctcagccccccaaagtgctaagattacaggcttgagccactgtgcctagctggaaattaacatcttaatcaagttagttatagagcttaatcttgaatgtggcttcttttctaccacgttataattggattttgtctctagtggtatgaagaataaaaacctaataaatgctggcagctaatattatctttgtctttttgtgtcccatcagttttcattcctcaggaattaatttttatgggtctcttttcactggattagtgctgatatgacagaaaatgtctattttaatactaaagggtcagatggaagagtgaatcccttttttatctatctctgtatctactataattttttttagcattaagtaaaatataaacttttgagggaaagactatctaaaatcagagcatagtactctgcaaatattaaagaagtgaatgacttaaaaatgatcttaagttactccttttgcccctcatcctatgttttcaaaaagctcgcatttctggaaggcctaatatgtgccaggagcattttacagaaatcatctaatttaaccctaagaccctgatgagctgggtattagcagaccaaatgtgtgataacgggcaaattacttaactgctctatgcctctgtttcctcatttgtaaaatgaggatgatgatagtacctatctaataaggatattaggttattacatttcaagtgcttagaagagtgcctagaatataatgtgcccaatacatgttagttgttattattgtccttttcattcctaagccagggtcattcatctggcatgttgtaaaagggaaaaacagtttttcctctctaatctttttttttttttttttgagacagagtcttgctctgtcatccaggctggagtgtaatggtgcagtcctggctcactgcaacctctacctcccgggttcaagcgattctcctgcctcagcctcccgagtagctaggattagagatgtgcaccaccacgcctggctaatttttgtacttttggtagaaacggggtttcgccatgttggccaggctggtctcgaaatcctgacgttaggtgatccacccaccttgacttcccaaagttctgggattataggcatgagccaccgcgcctgacccctctctaatcttcacactcaacacagaacatttctgtgacaacgtatgtgaggattttttccccatacaccaaagtaattctcctgtgtacaccaactaggtgtcctataatttagctcaattttgacattatttacctctaaatagtgtcagatctcacagattaaggactcagtcccaacacgactgtctcacacttcaggcgccaattgaaagtcccaggttgtgaactgtgctccgaactgatcagttataaattggagttcccatgaccccctccttgggttccattaatttggtcgaacagctcacagaaatcagggaaacacgtttaccagtttattatgaaggactttaaaatgatacagatgaagagatggacagggcaaagtataggggcacagagtttccaagccctctctgggcaagccaccctcctagcacctccacaaggtctgcaaccaggaagctcatcaagagtttttatggagcttgatctctagcctctcacccctgccctttttttttttttttttttttttttggagacagggtctggctctgttgcccaggcttaagtgcagtggcaccatcttggctcaccataacctctgcttcctgggctcaagcagatcctccagcttcagcctcctgagtagctgggactacaggcacataccaccccacccgactaattttgcattttttgtagagatggggttttgccatgtttcccaggctctttccccaattttttagaggtcagtgggtggggctgaaagttgcaaccctctgatcctttttctttttctcatgagtcagtttggtttcaagtaacccttcaatcctctaatcatctggtctttttggtgactggccctatcatgaggttatctaggggccctactgtaagtaacctcattagcataaactcagtatttatcaaaggtactcattatgaataacaaaagacattattatcactcaggatattcttagcgttttaggggctctaagacaggaaccagggacaaagaccaaaaatatgtttcatattataccacatgtggtggagccaggatccaagctcaggtctgtcaggttccaaagcccgtgatgtttccattataagatgccagagtgaataatagttggccataaccgggatggtcagtcatatgatgtgtttgtgttcagagggcttgaacctgtcttatcctagatatatggctatctgccacatatgatgttttagtcagtgataagactataaatacccatatatatgacagtaatcctgtaagattatactatatttttactgtaccttttctctatatagatatgtttagatacacaaatacttaacattgtgttacagttacctacagtattccatacagtaacatgctgtacaggtttgtagcccaggagcaacaggctatacctatatggcctaaatgttgtagtatatcatctagccgtgatatttgcacaatgacaaaatcgcctaacagcgcatttctcagaacatacccgtctttaagcagtgaatggctgtaattcacagacgggagcttggatgaaatctgtaattccttctcagatccaggagatgggccctaaattgtgaaaccagattgtaacaggattaggagttatcttcattctcatcccagctcttaccattaatctataagactatatagcctaagctataagtaaaacctagggctctgtaagaccttgatcaagtcttttagcatctcagccagttttaaaacactcaaatgccagaattctttatgtaaaaagtagcttagaatcatccacagtaggaggttttagatttaaaaaaactatctagaatctatattttgtagtatttttattgtctgttatccaagagatttttaaaattctcttcctgttcatgattgatttttactgtcttggaatatattaatttgagattcaatgaagatatacccttaactcttatattgtttctttttttttttgtacaagcaagtctctttatttccaaagtacgttgacctctccaacccaagttaaaagaatacacagtatgattccatcttttaatatattaacatcaagatgtacatgtttgaaaatggttggaattttatactggaataatgcatactaaactattaatagtttctacctctgagggtcatgggtgtaaggggggcatgaaagtaaacattcatattttactctctctgtcttgtgtttgaatcttttataatgggagtgcattcacatgtaataacttttatttttacaaagaatgagttttcccaagagcaaaatgcaaaaattctgctatagcttgttgacatttaatggaaatatattgctttatataatatatgaattgttcagaagtgataatagctttaatcatgctcccaataaaagatatgctagttaaagaaattctatagtttattccataaatttaaaaacatgtagaaaacgagtaccacccataaattaaatgatgtatttggtgcagggcaggtaagccccaaagttggggcttagctcgggacagttcttggctttgtctaagaaagaagtcaaaggcatgacaatggtaggaacctctgctgaagcggcagcgtacagcagcagcaaaagtactgtttcttgtggagcagggctattccataggcagtctgcctcgagtagcctatattgctctttatatttagtaattttttagcagaattctcaatctcacatttcttaaccttccttctcttttttcaggatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagtaagtttacaaaactacttatattctcattaaagccctaaatgctgtagtaagaaacttagagatgagtcttggcaacatagtgagaccccgtttccataaaaaagtaaaataattatccaggcatggtagtgcccatctgtggtcccagtgactcaggaggctgaggtaggaagcctgggagatcaagcccatgattgtgtcactgcactccatcctgggcgacagagtgagaccctgtctccaaaaaacaaaatttttttgtaagatattctttatgaaaattagaagataccactggccattataaaaagatatttaagatttaactgataacaaactaaaatcacattgcctatatagtgacactttctttatagtgtgtttatggcaatatttatagtgaaagtttatatactagagtagtatataaactagagtagtaacatttaggttttttttttttttttagtggtaagtatattcaagatgaaggaagatacattttattgaccatagctctttaccttctatggattttaaacttaaagttggaaagaagctttatattattttaatgttttccaaagtaaaaatcattttatcttttaaatgactataaaaataatgtagctcattgtaaaaatattcagaaaaatagatatataaattagatgaaagtcactttattttataacacccagagataacttatccttatatatttctgtgcatacatacgaatgtatgtgtgtttgcaaaaataggatcccactattttataacttactgtttttactctgtatatcataaacattgtccatgttaatgtatatacttcaacacaatttttaagtataaataatgtgatgttatatggagacaccataacatattttaactatctattatccataggttgtagagttttttcctttttttttttgttattgtaaacaacactgcaacaaacatatttgcactatgccttgatattctaatcatttttttttttgacatggagtctccctctgtcacccattctagagtgcaatggcacgatctcgtcttactgcaacctctgcctctcaggttcaagccattctcctgcctcagcctcctgagtagctgggattacaggcgcctgccaccacgcccagctaattttttgtatttttagtagagacggtgttcctctctgttggctaggctggcctcgaactcctgacctcatgatccgtccgcctcggcctcccaaagtgctgggattataggcatgagccaccgcgcccagtcatatattctaatcatttttaaggatatattcctggaagtggaattgtagtgctaaagactagatacatttttagaacttggaaacactttgccacgttcacttccagctaagttccagtgtatgtaagcttccttctttcttcaccctttcccttcactaactcggtattaccttattctttttctttttaattctttttttcaaaatttgttttgttttcatatcggttctgcagatatcccattaatttttgccagtctaatgggaaaagaaatctttcttcttctcttctcttttttcttttcatttctttcttttcttttgagacagggtttcactctgttgctcgagctggaatatagtggcacaatcatagctcactgtaacctcgaactcctgggatcaagtgataataatctgtaccatattggtagaaaatatattcttttaaacctaatgctttttctctttttaaaaaaataggagcaagcatttgatccttatgaaacattatcacaggacattctttcaccagagtttcatgaacatttcaataaattgatggccagacctgcagttgctctacactttcaggtaaacttaaattgaaggttttttttttttttttttttaataaagcaaataaatatctcactattttatccttcaaatatttgtaattctggaatcctcgtaatccttcaaatcttgttcattctaaacctgttttggattatcttctgttttctctctggagttctgtctgttcttattgtagaaatcttttatagtacaacatcatgagtactgaatgaccagaagaatttggcacatactagatctggggtataaagatgaatttggctgggtgcagtgactcatgcctagaatcccagcattttgggaggccaagacaggtggatcacttgaggtcaggagtttgagaccagcctggccaacatggtgaaaccctgtctcgactaaaattgcacaagttagctgggcgtggtggtgagctcctgtaatcccagctactcaggaggctaaggcaggagaatcacttgacccggaaggcggaggttgcagtgagccgagatcgcgccactgcactccagcttgggtggaatagtgagactctgtctcaaaaaataaatagaaaaataaataaaaaataaagatgaatctggagtgtgatttcaggattatgttccctataggaggaagatttggagaaatcttaaaaagttgagataacctcaacctcctatgtactcatactgatttttctatgaggcctacaatttaaaggagataaatactgtattgagggagagtatgcaagttagttggttcaggaatacacttagataaaatgaaaataagtggagagatacaaataaaattttatttttactatctcaacactaacaacaaaagttatgttggcataggtaatacttggctaaatatgtaaaacttctacatctaaactgacttttccagccagacgtggtggctcttgcctataatcccagcactttgggaggctaaggtcagaggattgcttggacccaggtgtttgagaccagcctgggcaaaatagggagacctcatctctacaaaatataaaaacttagccgagtgtggtggcgtgcacctgtggcatgccaggagaattgcttgagcctgggaggtcaaggctgcaatgagtcatgatcacgccactgcactccagccttgggtacagagtgagacccagtctcaaaaaaaataaaaataaaaaataaactggcttttaccccttgacgtttgaatatggtaaaaatccttatagtcctgaaacaaacaagcaaacaaatgaacaaacctttcttcactctagtagaataattaactagagtgaagaaagttttttcatttcctctctcattttttctttgcagccaattgtctttatattattttttaccattctttatgaaaacactaccatgtatgttttaatcaggatataaattgcctttgacaagtaacttaattgccaaatccagtggatatttttatttcatacttaatgtctgtagtatttgttactgctcttatctcttggttcctgtatacctgaaggctgggcgtgatgtctcatgcctgtaatcccagcactttgggaggctgaggtgggtggatcggatcacctgaggtcaggagttccagaccagccttgccagcctggcgaaaccctgtctctactaaaaaatgcaaaaattagctgggtgtggtggcatgcacctgtaatcccagctactcgggaggctgaggcaggagaattgcttgaacccgggaggcggaggttgcagtgagccgagatcgtgccactacactccagcctaggtgacagagcaagaccctgtctccaaaaaatatatatatatatatgtgtgtgtatatgtgtgtatatatatatatatatatatatatatatatatatatatatgcacacacacacacacacacacactagcgggcatggtggtgcacacctgtagttctagctactacagaggcagaggcaggaggatcacttggaggcaggaggatcacttgaacccaggaggtgggggttgcagtgagccgagattgcaacactgcactcaagcctgggctacagagtgagactctgtctcaacaaaaaaaagaaaaagaagactgagactgggtgatttataaagaaaagagatttaattggctcagagttccacaggctctacaggaagcacggctggggaggcctcaggaaacttacgatcatggcggaagccaaaagggaagcaggcacgtcttcacatggtcaaagcaagaggaaggagcagggaggtgccacacacttttaaacaactagatctcctgagaactctattacaagaacagcattaaaggaagaaatccacccccatgatccagttacctcccactaggccccacctccaaaattggggattacagttgaacatgagatttggacggggacacaaaatcaaaccatatcagctcctgtgatactacatgttcccaattttcgtcttctctgatttcttcttctaagtctcttaattattatagctattatccaacttctgttatcagcccctgtttttctgttctgtgctctccttgggtgacttcatgtctatatactggtgacttcttatttgtatttccaggccatcactttcttttaagcactgtgtaccgtgtacatatgtgtatgtatctatacactttcatataaccagctgccttgaattgatgcacttggataccctaaacgcacttcaaatatgacatgtttaaaactgaacttaccatcttctccctgccttctgtactataaattcccattgtttattatcttccacttctctattgtcaaaaatttgttatcatggaatacaaattatacttaattctcaaaattacttcaagagaggaatatttttaaagttaactcatatattcatataaagtatgcattaaatacacagtctataagaactttggatactcattaaaagcactcaacacatttcttgtttcagtcctattttattaggaatttttgctgtggaatttgaatgttaaagggcccagttattaataaagctgtcatcctagatattcagtgaaattggaagagttagatgaaatcctttttcgggccaaactcaattgttttaacttaaaaaaaaattcattcagtttaagataaaataatgcttccttaataaaactaaaaacaaaaagcatctttagaagctgtgtagcgtactttatttatttatttatttagagacagggtctcactctgttgcccaggctggagtgcagtggcacagtctcagttcattgcaacctccgcctcccgggttaaagcgattctcctgccttagcctcttgagtgactgagactacaagtgtggaccaccacgcctggctaattttggtatttttttggtagagacagagtttcaccatattggctaggctgttctgttgaccatgaggcaccatacctggactgtgtagcagacttaaaaaaataagatttgaagttagaacttaaggctttgggccaattaatagttttgtttgtttgtttgcggcggaatctcgctctttcacccaggctggagtgcagtggcgcgatcttggctcactgcaacctctgcctcttgggtttaaggagtcctcctgcctcagcctcctaagtagctgggactacaggcgcatgccaccacacctggctaatttttgtatttttagtagagatggggtttccccatgttggccaggctgttctcaaactcttgacttcaggtaatcctcctgactcagcctcccaaagtgctgggattacaggcgtgagccatcacgcccagccccagttaatggttgtgttaccttgagcaattcacttaatctctgagactcagtttgctcatttgtaaaatggtgatcatcataatatatacctcttatagttattaggaaattaaatggtaatgtatatataaagcataagcataatgtttgatgtgtattaaatactcaaatgtagctcctgttattatcagaggactccttacactgtaaatacatgctacaaaaattttagaatgcactttatcaggcattttagtacaaataagcaaaacagttgatcttgtagactaattttgaagtttcatattggttccagttcaagcactgtatataaaatatccagaataattcactatattaattagtttaatactgtcttagtctattcaggctgctctaataaaatatcataaactggatggcttataaacaatagaaatttatttctcacagttcacatttaggaagtcccatatcaagaggctaacagatttggtgtctagtttggtgccctagtgagggtttgctcttctggttcatagatggtgctttcttgttgtgtcctcacatgatggatagcacaaacaagctcccttaggccccttttataagggcactaaccccgttcacaggggctctgccctcatatccaatcacctcctaaaggccccatctcttaatactgttgcattggggattaggtttcaatatatgacttttgagggaacacaaacattcagatcataacaaatgtgaaaatgaattaatctttaggaaaattggtggcactttttgtgtatcctagtaagaagtttggttactggataataagtctgttgaaaagattataatttaacaaaatgtgaaaattatggtaatatttatgaagatttttttaaagcagcatatcagattctttctcacattttatattggtgtggttggtgtttttcttatggggagaaatactagtaagtgaactatatagacatttaaaattaacatgagttaaatccattataaattttagaaaaccatttattctacagtagtttccaaaactggggtatacctatcccaagctatacactaagatttttcaggatatataaaggcacagagagctttaagggaatctgtttctagtcttcggagatcttgtttatgttttttgcattgtcttttccaaagtctcttacttgttaccttttgctgttatgtatttcccattatgcattgatccaagatgtaaaaacctctagggcaccaaacaggaaaaaaaaaaaaaaaaaaaaaagtattactcctattggagagttcactgagtaccaagcaaaagagttcacaaaagaatgttatagggggatgatagtaaaaattcttggtagccaaaatgtcatctatctatgttatgtcatatctatctgtctaagaattaagaagtgatatggttatcacaaagatttatgttaaccttattgtaagtacttcatcatcatttgggataaagaagaggagaagcttgtaaagttctcataccttgatgtaatatgtcagaagcagttgtagtttcctccagaggcttctaatccttgagaccatgacattaataatgtttgtttgaatttaacaataaagtttgacttctgacaaactgagctgatgttgctgtttattttgacagtgaagatcgactttgtcaattaagttgtatgacagacgtttttcataaatgagctaaatctgaaagttattcaattattgtttagtgaaatagttataaatcacatttacagtatacagcattccctgaaatgcatcttttgtaactatttaaatttaaaacattttaaaattgtgcaggagagtacatagcttttcagaattcctttagggtatatggaagccagaacataagctgtagaggattattgtgaaagctattttagccacataaaagaaaattaatgtatatatttctctaataacttaaaggaggaaagggagaaaagaacaacttgatagcacttcagtttcaatatagaatatgcattctgttgtagttttgataagtctgtatctcaaatttttagtagacgtttctgttaggcactgctgttgcatatccttgatgtcagagacatacatactgtgatatctttttgctttgcagtccattgctgatggttttaaagaggcagttcgttatgtccttccacgtcttatgctggtgccagtgtatcactgttggcactactttgagttactaaaggtaaggttttataacagaatctcaaagtacttatctaatagaagagtttactttttaaaattaattttggagacacacagtaccagtcttttaattcttattttatgtaagtatttaataatttttatatgtaacattgctctaaatttctatcttgttatcttataaaggaaataacttttgaagttaatatttttttctgtgcagtgttgtattcttcctctcttagctgggacccaagcaacacattaaaaatatatatataacttaaaaaaaatgactctcttctctattttaattaactagccaaccactagtcctggtcacattggctaagagggtttggaggctagtgattaattggtggcaaaagtagctgtggcttaggatgagtcaggccattatagtcaatgacctgatcttaaatgcagacctagtagcaaggatttttaaaaagcaatcatctaggtaggggaaaattttttttaaattatatggtcaaaccagcatttttaaatgttggccaatattagagggcaactctaagactaatgataggacctctaataagacatgaaccttatttttaaaaattaaggcatccaaatatatgcttatatattattcatatgaagccagcatatcttttgatgagttctttatggatccactagtatccatggagacttacacaatgaagttgctcatctatttgtggataaaagctgactactgccgggcgcggtggttcacgcctgtaatcccagcactttgggaggccgaggcgggtggatcatgaggtcaggagattgagaccatcctggctaacatggtgaaaccccgtctctactaaatgtacaaaaaattagccgggcatgatggcaggcgcctgtagtcccagctacttgggaggctgaggcaggagaatggtgtgaacccgggagacggagcttgcagtgagcagagattgtgccactgcactccagcctgggcgacagagcgagactccgtctcaaaaaaataaaaaaaaaagctggctacctccagcatcaaatgctgtgggtagtagcactccataaaaaagaacttaaaaaagagataagtattcattagaaataatcatatatattccttgcctagatgcctacaaggtatacatagaattattatggcttttattttaatgttactaccatggattagacggaaaaagtcgtaactgtctatctaaaccaacgatgtggtatcctaaaggagaggtacgaaataatcaagcagaaagatactttgcttctaaagagcagttaaaaagttggaagctgggcatggtggccacaagcctatagtcccacctacttgggaggctgagataggaggatcacatgaggtcaggagttcaaggccagcctgagcaacatagcaagaccctgttaaagaaaaaaaaattgagaaagaacattttactgagcaagatatgtgggaattacagttgaaaatgggccataatctgaaagtagacagaagttcttagatgttagctagagtcagtgaaaatcagtagcagtaatagagagaaatgaatggattgtcaccagaaaatctccatctttcacgtgctcactttggtaatcactcctgcctttaaaagatcaagggaaattgtgtaaggaattagaaatgggaaaagaaacactcactgatgagtactcatgcttgtccaaaggcagcagatactctttattactaggtagtagtaattttgggcttcaaagaatgaataaagagagccaggtgcggtggctcatgcctgtaatcccagcactttaggagtccaagggggagggaatgacttgaggctaggagtttgagaccagtctggccaacatggcaaaatcatgtttttagtctctactaaaaatacaaaaattagctaggggtggtggcacatgcctgtaatcccagctactcaggaggctgaggcaggagacagcttggacaacagagcgagactccatctcagaaaaaaaaaaaaaaggaatgaataaagagaaactacccatgtctgatcaatgaaactgtaaccgttagaataaatatggaatatactcagttttaattaatgcacagcaacaacaagaacaaatagaaatgtggaatggaaagacaagccttagaagagattagaaatggcaaaagatttgaatcacttcacaaaacaggatatccaaaatggcagtaaatgtgtattcaaaccattaatagtcaaggaaatgcagttaaaaccacaggataccactacatacacatcagattacagaaatttgaaagtctgaaaatatccataaacagcagcatgaactatttgcattctgttaggaatgtaaactgtataacccactttggaaaactgcttggcattaccttttaaattaaaaaatatgtatactgtctgactaggcaattccacccttgaatatatactctaaagaaacaaaatgcaggcacatgtataccaagagaaatgtacaagaaagtctgtagcaggtgtcagtaatagcaaatcctgtttgccaaccagaaaagggtaaataaattgtggttcattcagataatgaaagaaacttacactagaacaatacacaacatcaatgacgcttacaaataaactttgagagatgataatatttcattggtgtgttataccatattttatttatccattcatctgttgatagaccgttgaatttttttttttttttttttttttttttgagatggaattttgctctgtcgcctggctggagtgcggtggcatgatctcggctcactgccacctctgccccctgggttcaagcagttcttctgcctcagcctcctgagtagctgggactacaggtgcatgtcaccatgcccagctaatttttgtatttttagtatagacagggtttcaccatgttggccaggatggactcaatctcttgacctcatgatctgtccatcttggcctcccgagatgctgggattacaggggtgagccaccgcgcctggctgactgttggatttttttctaccttttggttactataaataatgcttctgtgaatgtgagtgtacaaatatgtctttgagaccttgctttgaattattttatgtatatacccaggagtggaatggatggatcgtatggtaatgttatctttaattttttgagtaactaccacactgtttttcatagtaatggcaccattgtacattcctaccaacagtgcacagggttctgatttctccacatctttaccaaaccgtgttaatttctttttctttttcttttttttttttgagatggagtttcactcttgttgccctggctggagtgcaatggcacgatcttggctcactgcaacctccgcctcccaggttcaagcgattctcctgcctcagcttcccgagtagctgggattacaggcgcctgtcaccacacccagctaattttttgtatttttagtagagacagggtttcactatgttggccaggctggtctcgaattcctgacctcaagcgatccacctgcctcatcctcccaaagtgctgggattataggcgtgagccaccctgcctggcctgtttttttttttttttttaataatagtcatcctaatggatacgaggtggtatctcattgtggttttgattttaattttcctaatgactagtaatgttgagtatcttttatatacttgttaactatttgtatatcatctattttattgtgttgtttttgggacagggtcttgctctgttacccaggctggaatgcagtgatacaatcatggcttactgcagccttgacctcctgggctcaggcgaccctcccacgtagctaggactacggatgtgtgctaccatgcccagctaatttttaaattttttgtagagatagagtctcaccatgttgcctaggctggtcttgaactcctaggctcaagcaatctgcctgcctcagttttccaaagtcctgggattacaggcatgagccaccatacctggctatattttttttctttggatataagaattatgttataaagttacttataaatcaagaagtgattttttttcttttccttcttgcatgaagattgaattatatgttaagataataatctaaaattatgtttaaaaagcagtttgtagaaatttatctaaaatttatcttagaaagtggggtaaggtgcctcatgcttataatctcagcgctttgggaggccaaggtgagaaggtcacttgagcccaggagttcaagaccagcctgggcaacaaagtgagaccttgtctctacaaaaaaaaaaaaaaaatcagattagctggacatagtggtgcatgcctgtggtcccggctactagggaggctgaggcaggaggattgcttgagtccaggaggtcaaggctgcagtgagccatgtttacgtcagtacactccagcctagatgacagagtgaaactctgtcttaaaagtaaattaataaataaacaaaatttatctgagaagaaaaatgaaaacagtagtttgtgatcaaccttatggggcttaaatttgaaaagaacaaaaaagtattatctataaagtgaatatattatagatatatattctatatatctgccatgagttaactatatatatgtaacaatatatattgccatgcaatataaattgttgcatggcaacaataatataacattattccaacaatgtatataacaatatatattgccatgagtaacaataaaccaacaatgtactttgtttgttttttgaggcacggtctcactctgtcacccaggctggagtgcagtggtgcaatcttggctcactgcaacctctgcctcccaggttcaagtgattctcctgcctcagcctcccaagtagctgagattacaggtgaccgccaccacacccagctgatttttctatttttttttagtagagatggggtttcaccatgttggccaggctggtctcaaactcctgacctcaagtgatccacctgccttcggcctcccaaagtgctgggattgcaggtgtgagccactgtgcctggcctgtttgtttgttttttatttttatttttattttttttgagatggagtcccactctgtcgcccaggctggagtgcaatggtgcaggctcggcttactgcaacctccacctcccaggtttaaacgattctcttgcttcagcctcctgagtagctgagattacagatgcgtgctaccatgcctggctaattttttttaatatttttagtagagacggggtttcaccatgttggtcaggctagtctcaaactcctgacctcaaatgatccgcctgccttggcctcccaaactgctgggattacaggcgtgagccactgcaccaggcctaacaatgtactttgaaataattttaggtaactatatatggtatcctctaatttcttgtcatatagttgtttttccatcttgttttatcataaatctgattttggaaaataaaaaataatatttaaacactaaatccaagaataaatctctcttggtagatcaccaaagcagatactttaaaacagtgggttaaaactgttccaggattgtgttttctactactaaagggatgtaataacctttgagtcacactagtccagccttctttcttatgattctcatcccaaagtaggcttaacatgagacagaatttattttggatgagtactgagccaaaacagtatcacgaaacggcattctatagaatgggaaaatatttgtaaattatatatctgataaaagattcttatccagaatacataaagaactcctacaactcaacaacaaaaaacaagctgactaaaaaaatgagcaaaggatttagacatttctctaagaaggtatataggcgaggcacagtggctcatgtctgtaatcccagcactttgggaggctgaggtgaaaggatggcgtgaacccaggagtttgagaccagcctgggcaatatagtgagacctcatctctacaaaaatttttaaaattagctgagcgtggtaatgcatgccagtagtcacagctacttgtgagactgagatgagaggatcacttgagcccaggaattagaggctgtaataaactgagatcacaccacggcactccagcctgggcaagagagcaagaccttatctcagaaaataatctatgtctgtccttttttactaaggacatgttaactctctcattttagaactggtttattcaaaggcaagtaatgttctcttactctcctaactccctggtcattccttggaaatttagtaatggaaagaataaaaattattctctctcaagaggaattaatttagtttaaagcttaacaggaaaacttagtaataacttcaatgaggttcattgaggaagatcaaccagtatttcaatatgaaacaattgagtttataggtaatatttttttaccttttactttgaaaaacagaaaaaagttacagaaatagtggtgagcacccttcacctggactcactttttttttcttttttttttttgagacagagtctcactgtatcgcccaggctggagtgcagtggtgatctcggctcactacaacccccacctcctgggttcaagcaattctcccacatcagcctcccaagtagctgggattacaggtgcacaccaccacgccattctaatttttgtattgtttgatagagactgggtttcatcatgttggccaggctggtctcaaactcctgatttcaggtgatcctcctgcctcagcctcccaaagtgctgggattacaggtgtgagtcattgcgcctggctaccagttgttaacattatgcaacatttgcttgttatcattcctgttttttttagacagagtctcactcttgtcgcccaggctggagtgcagtggcccattcatggcttactgcagccttgacttcccaggctcaatcaatcctcccatctcagcttcccgagtagctagaactacaagagcatgccaccatacccagctaatttttgtttttttattttttgtagagaaggggttttgtcatgttgcccaggcttgctttgtcattctttttgtgtgtgtgtgagtatattcataacataaagagcttgcaatctctattgaaagaaatctctcaactcttaaaaaagaccataaagaggattttactacatatttactttttcagtactgacatatgattcaggtacatatgaaagaaagttaataacagttaactttcttatgtgtttttttttaaagttagtgttttttttaaaaaagcacgtaaagaaatatgatcacgggttttttgtttgttttggggtttttaggttatttctttttagagagggagtctcgctatgttgcccaagctgatctcaaacttctggcctcaagtgatcctcctgccttgaccttccaaagtggagagattacaggcatgagcccgtgtgcccagcctagtcataggttttaatggatttaatttcccaccaaattaccaactccactcttatgaaaatctagagagtttattactaataaaaaagaattgattacatgttttatttcacacctagactgaactcctagtacagtgaattagagacaaattcataatttattgaaattccccttgctgtgggcacatatgtccatagtagatgtagcatttggtaggagtttcaagaaaagcagggtaaatatttcagtgaattctcatacagagttaagaaaaaacttacatgaaatataaaatcttagacaggatacacttatagacaactaaggataatgatgagtatcaggtagcaaggaatatattcttcagctaggttcataagatattacccattaaagctaggcgcggtgggtcatgcttgtaatcctagcactttaggaggccaaggaaggtggattgctggagctcaggaatttgagaccagcctgggcaacatggccaaaccccatctctacaaaaaattcaaaaattagctggatgtggtggcaatgcctgtagtccaagctactcaggggttggggggttaaggcaggaggatcgcttgaacccgggacatcgaggatgcagtgagccgagatcgtgccactgcattccagcctagttgacaaagtgagactttatctcaaagaaaaagaaaagatattacccattaataaacaatcacttttatttttaattttaagcatatgtagcaagggtatcttttctctttgacctcttttccagagtacactcatttcattttatttcttaaactcagtagttatccagtttgttttcaacatagaaagaatccctttcaactcagtggtcatcagatttagacacagaccagtgttttgcgtagctgtgtctggtgtcatggtagagccacggggtattagtgtagcaaaaaagcagagactttggggtcagagctcctgggtttggatataaactctcctatttatattgggcaaattacttaatttctctgtgcctcatttccttcatctgtaacatatgattatagtacctcgtgttacagagttgtaataaaaattaaataagctaatgcataaaagagcgtgcacagagcagagctcaaaaaacattcattattggtctaaatacttaacaaaatcatacagtagtcatttattccagttacttctgacaaccacctagtggatacctaccacatgcaggtaaactgaaaaggaataaaacgtgtccctaggcattaagatgtttacaatttagtgaagaaaatagatgtcaaacaaataattacaatattataagagcctaatagaggtagtactatgagatcaatgaagcaggagttactagctctgcttagggaaggcagaaaaaaattcctattgatttttcctttgttcagtggagtaaaaaaaaatacataatggttttgggtattcgtcctactgagagagagaacagtgtgtgcgcgggtgtgtgtgtccttatttatttgcgggagtcatgaaagacaaatgcttaggaactctccagaataaaagagacaatagaaacatgacaatttagtgcttcactgaccagttcctgttttgggggaaaatattaccttaaaggatgttattaaaacagttggcaaaattggaatatacactatagattagattatgcagtagattactcggtgttaaatttcctgaagttgatcactatactgtgattctgtaaaagaaaatccttgttgtaagatgagctatgagaaatattaaaggagtaaaggagaatgatactatttgagagtaatttgtgatacatttgacttttccttatattccaaaaactactgcaaaaccattcagccgtagtcccccttcctctggaaggaactgagtggatagtatcacaactactaaaaaaacgatctgcacacactggcacacagaatgatgaagcatgtgacaaaatgttaaaaattggtgattcagagtattacaggagttatttgtgttacttttacaacttttctataaatttgatatttcaaaagaaaaaatttaagagggaaaaggcataatcagaaggcatcttcaagaggaagcatttcaactgtatcctagtggctaaattcaccgggtggataaggaggtcagagactgttgtgtagaaagcgaatgggggcatgaaagtacattacttgtttgcacatagttcagtacagtaatttttcttttctttttctttcttttttttttttggagacagaatctcgccttatcacccaggctggagtgcagtggtgctatcttggcttactgcaatctccacctcctaggttcaagtgattctcatgcctcagcctcctgagtagctgggattacaggcatgcaccaccacgtccagctaatttttttttgtattttttatttttattttcatttttttgcgggggacagagtctcactctgtcacccagactggagtgtaatggcacaatctcagctcactgtattctctacctcccatgcttaggtcatcctctcacctcagcctcccaaatagctgggactacatgtgcacatcaccacgcccggctaatttttgtattttttgtagagacaaggtttctccgtgtggtcaggctggtcttgaactcctgggctcaagtgatctgcccgccttggcctcccagtatgttgggattacaagtgtgagccaccttgcctggcccagtaatttctgtgtaagatgtttggaacacattcttttaagtatctgtagaatattagttggatattcattaatatgatgtttatcaaatctcactgctgaaaattcaagaaatatttagcaaattatcagattattatgccaaacagagccgttgtttaatatacttccattaccaggaaatcccactctaaatatcctcaattttgttctcctttacagcttataattattacatggttatttaaaaatgacacgtggaagagtttgagcagccttaagaccaagtagacaatgaaaatcatacctttttggtaggatatcactactggtgataatttagatatttggataaacaaaaacaagaataaaacagttctaattaagtgtttgatgtcatcaacattcatatttattaaagaaatattttagagtggagctgagaagactttctgtaagaaatctttaaagcagcaaaataagtgattttgccagtaactttcacctgtagaagtcagaataaccaagcacagatcttttttcaaactttctatgatattttgactttgcttccatcctttctattgcttagtctagagattaaggtattacttctaataatagtcatttacattatttatgttgctaatctcttgatgacaagacctctacatgtgtcttgaaataaaatcaaatggctctgtgcttcatatagagactaatttctaagacataaataaaaggtaatggacaaagttgtcaaacaatagccagttagttctttgctgaggaaagggaaccattgctgaatgcttttgagattgctcttggaatataaggaaaattttaatttatcacaaaatctctaataagttaaagatcacaaaatagatttaagtttttaaaaattttctgaagtgatcataattccccatatccttgcataaatatatatttataaatacataatatatataatatctatatgatgttccactttgaactcttctttcaaaagattaaaacagtttgagggcagcctgggcagcatagtgagaccccatctctacagaaaaattaaaaaaaaaaattagccaagcatggtggcacacatctgtagttctagctacttgggaggctgagatggaaggatcacttgagtccaggaggttgaggcaaggctgcagtgagccatgatcacctcaccgtattccagtttgggtgacagagtgagaccctgtctcaaaaaaaaaaaaaaaaatcaaaacattggagcacaatacaatacaatctgaattatttattataagtaaatttgctttctttctgagagtgaaatacaagagaacattttggggcaaatgaaatagaaccagagttttagagattaataagtcagtttctaaatcttctaaagattgagatagaattaattttcatggtttcttgacatttcatattgtaaaaaatagcagtggaatcctttgagagatgctgtttacggaaaagtttatgatagattgaagtgttaaaagttagtacccttgattatgttatataacaaagatttgtaaacttgaaattgctaaaacaaagtaatcattagagaatatgaaatagtttatagttacttattttctctattcatagttgctaatgaataaaagtaagttgtaagcttcatgctttaggtgttttaaactttttaaatatgtttggaaaatgtggcctggcacagtggctcacacttgtaatttcaacactttgggaggcagagatgggaggatagcttgagtccaggagtttgggaccagcctagtgagaccctatctctacaaaaaataaaaataaaaaaattagctggatgtggtggcatgcaactgtggtcccagctactcgggaagccttatgcccaggagatcgaggctgcagttagccctgccactgtattccacccttggtgacggagtgagtaagaccctgtctcaaaaaaataaaaaataaaaataaaatgtccgaatggtttttacagttgcttttttttttcctgattactatgctcatgttagtttatatctgtattgtgtttatgtttatagaaagaaggttgggccaggactggtggctcatacctgtaatcccagcactttgggaggcagaggcagaaggatagcttgagcaggtgttcaagaccagcctgggagacatagcgagaccctgtctctacagaaattttaaaaattagctgggtgtggtggcattcgcctgtggtctcagctacttgagaggctgagagtggaggatcattagaacccaggagctcaaggccacagtgagtgagatcctgtttcaaaaaaaaaaaaaaaaaagaaagaaaaagggttggtttgagagggcagtaggtatatataaaattatagctgtttttattaagtatatataaaattaacttagagttgataatatttgttgctgctttttctattactagaaagttgggggaagaatcaaacaatgcagttttgatttttctttctgttttttcttagcaattgaaagcatgtagtgaagaacaagaagacagagaatgtttgaaccaagctattactgctctcatgaatctccaaggtagcatggaccgaatttacaagcagtattcacctagacgtcgacctgggtaattccaaagtgttgaaaacgtgaatgcctctgcttacttcgctgtctctgatgcctggttttcaaagaagtgtgatttattgtgatagttacattattgaaagttgtgcttgtcatacttttatatacttttatgttggtcttttactctcttttttccttttcctttcctttttttttttttgagaaggagtctctcttgcccaggctggagtgcagtggtgtaatctcagctcactgcaacctgcagccttagcctcctgcgttccaatgattctcctgccttcgcctcccaagtaactggaactacaggagcccaccaccatgcccagctaatttttgtatttttagtagagacggggttttaccgcgtcggccagactggtctcaaactcctgacctcagcctcccaaagtgctcggattacaggtgtgagccgctgcgcccagcctttttttcttttttttaagagacagggtctcactctgttgcccaggctggagtgcagtgatgtgatctcagctcacagcagcctcaacctcctgggctcaagcagtcctcctgcctcaaccctctggagtagctgggactcgagtagctgggtggcacatgccaacacacctgcctaatttttgtattttttgttgaaatagggttttgctatgttgcccaggctggtcttgaactcctgggctcaggtgatctgcctgctttggcctcccagagtgttgagattgcaggtctgagccactgcacctggccaacccagcctagtcttaagattagcattgttggctgggcacggtggctcacgcctataatcccagcacttcgggagtccaaggtgggcagatcgcctgaggtcaggagtttgagaccagcctggccaacatggtgaaaccccatctctactaaaaatacaaaaattagccaggcgtggtggcaggcacctgtaatcccagctactcgggaggctgaggcaggagaatcacttaaacctgggagggggaggttgcagtgagccaagatcgtgccattgcattccagcctgggggacaagagctccaaaaaaaaaaaaaaaaaaaaaaaaaaaaaaaaaagattagcattgttatattattaggatagacttaataaatgtttaaaaatataatctatgaaagaaatttaggattttttgtaattttagttcttatagagccagtagtacttctctttcataataatgaaattgagggctgtattatttagtggcaaagttagaactaaatgctgtgcgtaaaagctactgtttggttatttaatattttactcacttgatttgagatggtttatgcttgaaaccatttgggttgctagctgttgaataagctatattgtttgttttttctagagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcaggtatgtgaaactcattacaactgctgacctagggcctgggacccaaaagctttttaaggatgctcaaaaatatttgaggcttggggaaaaaatggattgcctccaaaatataaaaatactgcaaaaacaaaaggaataaataagagaaggaattaaaggtctaaaaatgtaatattgttaacttcattaattattgaataaatattcataaaatatgcatattcatgaattttttttttttgagacagagtcttgctctgttgcccaggctggagtgcagtggcgctatctctgctcactgcaagctccacctcctgggttcacgccattctcctgcctcagcctcccgagtagctgggactataggcgcccgcaacaatgcccggctaattttttttttctttatttttagtagagatggggtttcaccgtgttagccaggatggtttcgatctcctgacctcgtgatccgcccacctcggcctcccaaagtgctgagattataggcgtgagccacctcacccagccatattcatgaatttcaaatttgaaaacaatcctcgcttattaaggatataccatagtatattctctatgtcagtatttctctatgtatggcagggataccatggtatcctgccagtaccatgattgttaggaaaagccacaatctgaggagccaaagtaaaaagaaaaagggaggaaggcctccaaatatggtactttgagttaattaaactgaatacattaaacatgaaacctattttatgctctgccttttcagatcccaattttgttcgtacttttcttaccacatatcgttcattttgtaaaccacaggaattgctgagcttactgattgaacggtaagaaaaatatgtatttcagttatattgacattttgtgaaaaattaactgtattttgtaaagtgcctagtacctaataaatactcaagttaattattgaacatattttatttggcattaaattggcagtattactattctcttcaaatggagtactccctaaaatctgtttataaacacagatcttttcagctcttagaaatatttcaagtggtaatcagaaagactaatttagaggatgaaagcactatattttaatgaatattgttctgtgtaataaaatgatattttcttaaaagagacttttctacttaccactatttttttttttggaccgtagactactttgccaaatactttccacttttaaaacaaacttgttatgaaaactttcaaaacacatacaagagcagatacaagaatataataaacccatttattcatcaaccaccttcagtaattatcaactcattgtttcatctgtttccctacaaatttaaacaccccaccccatgattattttgaagtagatcctagacaacataattcatctataaatatttttctatgtatctctagaaaatacgggatcatttttaataatcagatatcattattaaacctaaaaaatcagcaattcctttattatgattaacttttaaaaattagtgttgggttgaatttgttttacctagtattatagtggcattttaaatgttttatagtttaaaatgtagaatctggactccagaatgatttttagttttacgttttaaaacttactaaaacttattattataccaaagcttattaactgtattatcaagatataattctagatctctatcactatgttgttttatcaaactaaatttaccagactgagtcagtgtaatgtgctatgaggatctacttagttgtttccatgtccagaataaggaaagcacacgttagacttatagtttagctgtatttcctatgtttgagcaaggttttttatctttatcttatccacttaggtaaattatttaaatattgttaaatattcggttttggccctctctttgaatttgtactcatttaaataaatttattagcctactttcattttaataatataaatattaaagacattgttagataagcaatttctgtcatgttctttaaattccttatgaattctttccttggctcttttccctggaccttttctgtattatcagtgctaaaagacaaaactttagtttttataaaagtaagaatacaaaacgtcagttttgtatagccaaaggacagttttttgtagtatatcatacctcaagggaagtttaacagtaatccacttttcgtggaagtggtaggaaagaaggttgcttgctgttttcctccttgtattttcattatgtatgaacggatttttctccttttgcttttcttcttaggtttgaaattccagagccagaacctactgacgcagacaaattggcaatagagaaaggcgagcagccaatcagtgcagaccttaaaagatttcgcaaggaatatgtccaaccagtacaacttaggtttggcttgaatattttttatatatatatatatacacatatatatacacacacacacacattttatgtgtcagttttcaatatatagttaacacaaaagctctcagcttttaattcaaatatagggaatatttttaacttcacagcagttaagttaaactaaaagagttctttctcagtgaagctattcttaaataccctgaagaaattcaaatatttaaatatcctatgtttgcatcacatatctctggcatgtgatatgttatgcttacgtatcaggatacctattttttattgtaagtaaaaattataaaatttcatgtgagctttcctgctgtcaaccttttttcacacttttttccttcatttccctttgcgatcatacagtaatcctggctttttttacaatttataatatttgtggaagttctagcccttttcccacttatctctcacaaaatatatagacatttgttagtttaattgcaataatttctaaaaatgtgtttgattgtagaagcttccagttaataaatactactgtgtgccggggattaccctaaatgctttatcttttttatctcattcttacaacatgattactattcctactttatatataaggaaattgaaacctagcaaggtgaagtaatttgagctaagttatgtaaagggagtggcaggacaagattcagactcatgtctgactttctttgcgtgtgtgtgtgtgtgtgtgtgtgtacgtaccactaagcattgaaaattggaagcgccttctcttagccctctttactgtccaagtaaccaaagtattatcttcctccttccattggaaaccaagttatcttattaattatatgtaatttaaattttttttctctctaaatttcaagtttccttgattactgttgaccaataaattgtaattttggaactgagtatattagttatttatttcccaggataattgccacaaacaaatgcagttttagaagaatgatagtgctcccagctatatgtctttcactaaaacttttaacgtcattctttgtataagaagatgagattatttatgtatcagcaataaataagtaattcttttctactagctgtgatgcatttgtacttatctacaatcacattaaatcccttgatatgacacatacatttatgaggttgctattgggtggggtagggggtgggagtataatcttcgtttctcagtcatataagctctttatgtatttctaagcatttgctgtgttctcagtcctgtacttataactatgctaagtacaaaaataacatagactgtcatgatattgtggctttcttggggactttactgggggaaaaagacacatgaaacagttatatattgttctacttggagtgcttaagtgacttagaaaaatacatccctatacaatttcaggaatagcaaagattaggccagagtaattagggaaggcatcttggagaaggtaaaatctgagactgcccctaaaggatgtataggctttagataggtagaaaggtgactgtaggtattcagggtcatgagaaatagtatgaacaaagacaagaaggcagaaatgagaatggtgtgctgaggacacagataaggacattgacctgagaggaatgtaggcattgtattgcaagtagtagatgagattacctgtatggaattggatggagtggaaaactgtgaaatccaagccaagttattaaacctgtttatataaatattgaaagatttctagtaaaatgggtggtagtaatttttctaacattttattatgaaaaattttaacatacagcaaaactgagaattttacaatgaacacccataaacccaccacctagatatgtattcatctattcatatctattcatttatgtgttcatttatcattcatctatcagttcatttttttgtatgaattttgaagtacactccttaaatacttcaacttgtatgtcattaacagttcagtgtttgtttttcttttgttctaaaatgtgcatataattaaatacatttttttcttgctgccactgaagacagaagatacacacatcttaagtgtacttttgttgagttttaacaaatacatgtatctccataatccaaacgcctttcaagatatcaaatgttactacaccccagaaagttcccttatgttccttctcatcagtttttgttcccactgcccaaaggcagtgttccaatttctccctccatagattagttttacctgttttagagtcttaataaatgcattcttaaaaactcaattttgtgtcttctttcactcaacatgcttttgaatttgtatcaatggcttattttattgcgaggttgtgttttattatatgaatataccagtttattcatttttcccattgaaagatacatgggctttttctcgttttttattattatgaataaagccgctatgaactttatcttacctgtcttactgtgaatatttttcacttttcttgggtaaacaactcagagtggagtggctgggtcagaaggtatgtgtatgtttagttttgaaagaaactgccaaaacttccaaaacattctcaccaacaatgttcaagttgcttcatattctcaccagtgtttagtaatgtcagtctttgtgccttagccatactgctggatgtagtggtatttcattcatacttattttgtggagaatctgttcaaatcctctaatttttgttgagatacttgtctctttattactgagttgtaggagtaaattgggtaggactgaatgccagtcctttgtcagataaacattttgcaaatattttctttccatggcttgcctactagtttccttccttccctttccttttcccttcttcctcttccatttccctcctcttccctctccccttgtctttcctttcctttccatttgcatagttgattaaatctctctttgcaaggttataggtaatcatttttgtgatactgtaaaacaaaacagttctatttttgtcttttgaaatgaaataagagactgtagtatatgtgtagattacatagaaatttgatgataggctgggtgcagtggctcacgcctataatcccagcactttgggaggctgaggtgggcggatcacctgagatcaggagttcgagaccagcctggccaacatggtaaaacgtcgtctctactaaaagtacaaaaattagcccagcatggtggcgggcgtctataatcccagctacttgggaggctgaagtaggagagtcacttgaacctgggagttggaggttgtagtgagctgagatcgcaccattgcactccagcctgggcaacaagagcaaaattccatctcaaaaaaaagaaagaaatttgatgatagcacttgcatttagaaccagatacagtacatcttagttggttttccattttaagtgaaaaagtaccaaaatttaaatcttaaaaatgctttttatgaacttaaaatagcttttgtaatatagagcataagttttctacatatgaataaagggtacttttccttaacataaatgggaagcacagaaaccactatttttatgcttataaatattttaaaagtatacattttattaataaataatacaccgtttggagacctactctcctcttgtcattgaagcatttaaagtattaattaaatacagattagagagtctttgagtattatgttgacccttgtatgtaaagctattatcgtggcattagagaaggaagaagtgtaattgaacacttatgtttcactaaaatgtgtttctttccattttatcaggatcttaaatgtatttcggcattgggttgaacatcatttttatgactttgaaagagacttggaattgcttgaaagactagaatccttcatttcaagtgtaagaggtatattatataaaggtttgattgaatcttatattgaacatgagtttatgttcaaatttgtgtgactttaagaaactaaaacatttctctctcttttttttttttgaaacagagctttgctttgttgtccaggctggagtgcagtggtgccatctcagctcactgcaacctccgcctcccaggttcaagtgattcttctgcctcagcctcccaagtagctgggactacaggcacatgacatcacgcctggctaatttttgtatttttagtagagatggtatttcaccacattcaccacaagaccagcctggtgtcttgaactcctgacctcagatgatccacctgcctcagcttcccaaagtgctgggattacaggcatgagccaccatgcctggccagcatttttcatttttaaaaagctgaaataacatttggaatgttttttatagacagcaagaaactcacatatgtttagaccaatcatctgaggtctcagaactttgccttttcaagtttttgaggagaatatttcttttaaagaagtcgaaagttctttttaataaatttaagctatttaattttatctcattgcaaggttgccatttcttcaactgaataaaaatatgtgtaattttatgttttctttctttaatcttattcttttaatgattaacagctttcttataatatttacatcttctggaaatgtttttggtatatttctgaaatctgaaagagaggagttttctattttaagtttcagaatcatagcccaagaaatgaaaccctaggccatgaacatttaaacaaatgtgtcatcaaatgtatattattgaatcaagaacatttatgttttatctgacattatagggcattacaaatactataacaagtgtaacttatttcgtgttctacttgttctttaaggggaatattatttaaagttaagaatgttattcctttgtttctactttgagatgtttatgatacatttttatgtgtgccttgaaattgtcataatactacattttcaagttgtattctaggccagtgcaatggctcacacctagaatatcccagcactttgggaggcagaggcgggctgattgcttgagcccagaagtttgagaccagtctgggcaaaatggcaaaacccagtctctacaaaaaatatgaaaattagccaagcatggtggcatgtgcctgtagtcccagctactcgggaggctgaggtgaagcgatcacttttaagcccagagctcgaggctgcagtgacccgaaattgcaacactgcacacaagcctgggcagagtgagaccctgtctcaaaataaacaaaaaacaaaaatttatattctaaatgagaatactggattagacacaatctaagaagcttctaaaatacacacacacattagaataaattaagtaaatggttatgttaatgtccaaagttcttttctatactagttatacttcagaataaccaaatagttcatgaggaaaagtttatttttgtggaagtatttcagctagtaagtgaagaaggaatggtagaatatcacatttctcaggtcctagtaaaataataaacctagggaattatcatgactggatgggtactatcacaaaaagttaactagacattatatgcctcctgttagaagtattcttggcaagtatttgtgtcataaaattaatcctgaatcagaccaagtcactatatctctgctttacagaaaatatagaggacagaaaaacatggcaaatgacaatttcttccacaaagtgcaagcaaaaatatgcaataaagcagtaacctgtagattaaaggagacttgagacacattgactcagtgcaatatgtgcaatcttgttcagatcccttttcaaactaaatataagaaaatatggccaggcacagtggctcatgcctgtaatcccaacactttgggaggccaaggcaggcagatcacttgagcccaggagttcaagaccagcttgggcaacatggataaaccctatttctactaaaaatacaaaaattaggccaggcgcggtggctcacgcctgtaatcccagcactttgagaggccaaggcaggcagatcacgaggtcaggagttcgagaccagcctggccaacatggtgaaaccctgtctgtactaaaaatacaacaaaattagccaagcatggtagtgtgcacctataatcctagctactcaggaggctgaggcaggagaatcgcttgaacccgggaggtggaggttgcagtgagccgagatcacgccattattctccagcctgggtgacaaagtgggactccatttcaaaaaaaatacaaaaattagccaggcgtggtgatatgtgcagtcccagctacttgggaggctgaggtgggaggatcacttgagcccgcaacatggaagttgcaataagttgagattgcgccactgcactccaacctgggccacagagcaagaccctgtctcaaaaaaaaaaaaaaaggaaaataatcagagagagaaatgtgaacagtgacaaaatacttcaagataacaatgtattaagaagttgtcagttttatgtgtgataatggtgttgtggttattactttaaagagtgttttaaaggtgcttaaatatgaatgaaatacgatgtctcggatttgtttcagaataacctaggaagtgacgggatggcatgagtagggttagagaaaataaaaattggccatgagttggtaactgttgaggctgggtgaaagttaaggattaaatgaagatttgcagtcatgtctgtcaagtaaaagacatttttctttatgtgttctttttccagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggtagacaattaatgttaatgtcttgctttatttttaagaatcttgaacattacctattttcaaaacattttgcacattattcatgagtgcttaaaaatacctcatctactctcatgggcttagaggaaaggtcatagcacagtttttaactagtctgccctgcaagtaaaagtcttatgtctagactggggactagcaatccattacaagaggaatggcaggaagattttcaagtccaccacccctcttcaactcctaataccttctcaccttggtttagtttgaggtcagtcagtcaagtcagttagtatggatgctaggcccttagcagctaagtgaatagaatattgtgtgagatgggttttcttttctcatttacagctcaggctgttgcgaagggtacaggccttgcatgtaacagctctctgtcgaaaaatgtcactatcattatcattccatcaaaaactttttctacaccaacctctctgttttcccctcctcccaatccttcccagccactaatacctgcagttctactctctacttccatgagttcattttttttttagttttcatatatgagtgggaacatgttatatttttctttctgtgtctgatttattttgcttaacataaggtcctccgggctcatccatgttgccttgaacgacaggctttcattctttttttatggccgaatagtgttccactgtgtatatataccacattttctttattcattaatctgttgattccatatcatagctattgtgagtagtatagaagcctcaatttaaaatataaatgtgcttggctgggtatgatggctcatgcctgtaatcccagcacttaggaggccaaggtgggcagatcgcttgagaccaggagttcaagaccagcctgagcaacatggcaaactccgtcatacaaaaactacaaaaaatagccaggcatggtggctcgtgcctgtagtgcccctgtagtcccagttgcccaggaggctgaggtgggaaggtcacttaaggtcgaggctgcagtgagccaagattgtgccactgcactccagcttgagtgacagagtgagaccctatctctaaaataaaaatattttcatggagttatcctgattagcagccaatttttaaataaagattacacagggaaaagcaagaatatataaaatttagtgctaataggtaatatagtaaggtacctttactacattatgtttactttatgttctttagaatttgcctagtttgcactggccatgccattcagaaccagacttttagcgcacccaccagaagttgtcaacatctgactcaaaatgttatgttatattttaagtaatttagaatccaggtagctttgtttatgttgtgggatttgtgatacgtagaaatgaagggacttgttacttgaggtaaaaaaagcaaatagtactgcatcatgttttttctcacaatgtaattgttttacatgaatggacatcagaaaaaaagcacttcacttcatgtggacctactttcaggacatagaaaaatacctaatactgacttcatttgtaaactaaatttttttttttttttttttttgagatggtgtcttgctctgtcacccaggctggagtgcagttgtgcaatctcggctcactgcaacctgtgcctcccaagttcaagtgattctcatgcctcaacctcccgagtagctgggattacaggtgtgtgccaccatgcccggcttttttatatttttagtagagatggggtttcaccatgttggccacagtggtcacgaactccttacctccagtgatccacccacctcagcctcccaaagtgctgggattacaggcatgagccactgcacccagctttgtaaactaaatttctggtgaaataatagagccactttaagaaaacatttcagaaactgttagcaagtacttatttatacacaaatctactgattaaaaaatatttttttaatgaataaccaagtctgtaggccattgatggcaatgccaccagtcaattaaaaagaaaaaaaagagatagggtctcactgtgttgcccaggctggccttgaactcctggcctcaggcagtcctcctgccttggcctcccaggtgctgggattacaggtgtgagccactgtacttggccaatttttaaattgtgtattctgactcactgtatacaatgttttaatctgctcttctgtctgaattttaattaaatactcaggcattcaaaaaatataggaaataatataatgaatattcatgaacaacaaaaacattttagataaaattgaaatcctttgtgtaattctcccaaatcttattgctctctttcccctaagaaagcactaccaccctgaatttgatgtttactatttctctttatatttttaaaatttataaacatacacggagattcataaacaacgtatagcattgttgtacactttttttttttttttttttttttagaaacagggtctcactctgttgcccaggctggagtgcagtggcacaatcatagctcactgtagccttgaactcctgggctcaagcaatcctcctgcctcagcctctcgagtagctagaactacaggcacgcaccaccatacctggctaatttttttaaaaaaatttcatagagatgaggtcttgctatgttgcccaggatggtcttgatcttggcctcaagttgtcctcccacctcaacctcccaaaacgccaggattacaggtgtgagctacagtgcccaactggttttttgttgttgttgttgtttgtttgtttaagatggggtctcactctgtcacccaggctgggatgcagtggcatgatcatagctcattgcagccccagactctaggctcaagcagtcttcccacctcagtctctcagtagcaggaactgcagggaggaactactgtgcctgtttttttttttgttttatttttttgagataggatctcattatgattgcccaggatagtctcaaaccctttgcctcaatcaatccttccacttcatcctcccaagtagctgggattataggtgcgcaccactgcacctcagcttgttttgcactttttttaaactgcatatacttatgtatcattctgcaacatgctttttacttaaatcatttttggcatttgttcaagtcaatgaatacagttctagttagcttattttagatgctgtgtagtgttccgttatatttatactccacaatttatccagtctctggatgatgagcctctattcactcttgcaaataatgcttcactgaatattcttgtaaacgttttcttataactttgttttttgtttgtttgttttgagacagagtctcactctgttgcccaggctggagtgcagtggcatgatctcagctcactgcaaccctctgcttcctgggttcaagcgattctcctgcctcagcctcccaagtagctgggactacaggcacgcactactacgcccggctaatttctttgtatttttagtagagatggggtttcgccttgttggccaggctgttcttaaactcctgacctcaagtgatctgcccgcctcagcctcccaaagtgctgggattacaggcatgagctgctgcacctggctcttataaatttgtgtaagagtttatctagggtatatgcatacttaagagtcaaattgctgagtcatccgatatgtatctcttcagtactatgagatcttgccaaattgttttacaaaatggttgtatcaatttttacttccctattggtgttcctgttttattatatttttatccatttggaattatcagacttttttttcgtttctttttttttttttttttttttggagacagagctttgctcttgttgcccaggctggagtgcagtggtgcgatctcggctcaccacaacctccatctcccgggttcaagcgattctcctgcctcagcctcccaagtagctgggattacaggcaggtgccaccatgcccggctaattttgtattttagtagagacggggtttttccatgatggtcaggctggtctcgaactcctgacctcaggtgatccatctgcctcggcctcccaaagcgctgggattacaggcatgagccaccacgcctggccttgagttatcagacttttgttcatctaatgagtaaaatgggatttcattgtagttttatgttattttccctgagtaagggataaagtgtgttttcgtgtttgtagctatttgggtctattcctctctgaattacttgttcatatatgtgttcatctgtcttttgggttaattgtctttttcttattaagttttagaagatctttaagtaatacaaatcctttataggttaagttgcactgattttcaattccataggaaagttcaaccgtctgaacttgtagggagtgtgtggaccaaagaagataaagaaataaattctccaaatttattaaaaatgattcgccataccacaaatctcaccctctggtttgaaaagtaagttttaatttactcttactacctcctaatagccataatattaagtcatatttaagctaaaattctggctactcataattatcttgttttctaagtgaggtgaagaaacttttctaagccatgaatttttgttgttgttagatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggtaagttttaggcttaactttttcatttttctcggggatgatgaaattagcataaaagaaatttcatctatcatctgtctttttaattaaattctttgtaaattcatccttgcttcataaatatgatataaatatattagaaaatatgttgatatattagttaatatatgaatatgatatataatatgtgaatcctaggcttatattagaaaatatatcaatattcaataaacaatatgagacttgcactgccgtgtaatgtacttaacctaaatgtaatgaagttccaagtggatttattcaataacacattgattgatagtctcaaatgacaaaggattttaaatataaaaatacaagtaatgtcttaattacctttaggtagtcaacaatagtataacacgggaagaactatttcaaaaacttaaatttggccaggcgtggtggctcacgcctgtaatcccagcactttaggaggctgaggcgggtcgatcacctgagctcaggagttcgaaaccaacctggacaacgcggcgaaaccccatctctactaaaaatacaaaaattagctgggcatggtggcgcacgcctgttatcccagctacttcggaggctgagacaggagaattgcttgaactcaggaggcagcatttgcagtgagctgagatcacaccactgcactccaggctgggcgacacagtgagactcagtctcaaaaaattaaaaaatatatatattttttaaattataaaatatgtgtttaacatgtactattgaaaattcaggagatatagaaaataggaagatattttgcatatatattttaataacaaaattgagattacattgtgcatagatttttatggcccttttctcataaacagttttctatttttttattagcttatcttcaaaaacaagattttaatggcatcaaggttttctatcatggataaatcataatttattccaacagtagattgtgggacaattaagttatttctgatttttttctgtgataatttatcatggaatattcatatgtagaagtctttttaagagcttgattatttccctagaaataatctaggggtggaaatcctgggtctgagtatttatatactttaagactttaaatacttttgccaaggtgtttcgtagcaggatacgataaatgccccttggtattatgtattatattaaaagcttttggccaggtgtgggggctctcacctgtaatcccaacactttgggaggcagagacaggaggatcacttgagcccaggagtttgagaccagcctgggcaacatagggagaccacatctctacaaaaaaaaaaaaaaaatagccaggcatggtgttgcatgcctctggcgggggcagaaatcgcactgcatttttaaattgtatgttaaaaaataactagtgaggctgggctcagtggctcacctgtaatcctagcactttgggaggccgaggcgggtggatcacctgaggtcaggagttcgataccagcctggctaacatgatgaaaccccatctctactaaaagtacaaaaattagtcaggcatggtggtatgtgctggtttgcaatcccagctactcaggaggctgaggcaggggtatcgcttgaacctgcctggtggaggttgcagtgagccaagattgccccactgcactctagcctgggcaacagagtgaaacttgttctcaaaataaataataactagtgaggttgaatatgtatttattgggtactttatgatttatgtattcattgcctctctcatttttgggggagggtgttttcattttgttgattttttttttttttttttcctaaagagtcaagcttgctctgtcacccaggctggagtgccagtggcatgatcatagcccactgcagtctcgaactcctgggctcaagggatcgtcctgtcccagcctcttgagtagctgcgattacaggcattagtcagcatgtccagctgcattttattcatttatatggatttttcatatattaaagatattaaaacttagactgtacatatattctcatttctgtttgtcttttatctgctttttaatttaaaaaatgtataatgctttgacataaggacgttttatcatttttatttagttgcacatatcagtctcttcacttatggtttcttcctttgcttttgtacctggaaagactttttttaagtaaaggataacaagttagaaactcagccatataaatactgcttttgggaatgtgcgtttttacaatctttctggaaagcagtctaacaatatatgttaaaattaaaaatgtgcatactcttaggacccagaattgcaaagaaataaacacaccagagtataaagttatatgtacaaagatatagttactgcagcattagttgtagtagcagaaaacaggaaacaacctgaatgtctatcagtaagagaatgattaaatacatcctcttatacctctattgtagaatattgttcagctatacaacaaagtgaatgggatctatgtgtattgttgtggaagaacatttgtgatatttcagcaggggaaaagcttcagaatgactataatattattccattttagtatcacaaagcagagcaaaccccaaacctctaagtggaactggataagtattgagaataatgtgggaggttacatactcctcttttaacattatttatttattttttttagtgggttgttattagaggggaatagaggaaaaactgctttatacatatatttttctgtttgggtgtttgcattttattgatttgtatgaactttatatgttaaagatattaatacttagtcaaatattatgaaataggccgggggcagtggctcatgcctgtaatcccaacactttgggaggctgaggtgggtggatcacatgaggccaggagtttgagaccagcctggccaacatgatgaaaccccgtctttactaaaaatataaaaattacccaggcatgctggcgggcgcctgtaatcccagctacttgggaggctgaggcaggagaatcacttgaacccgggaggcagaggttccagtgagccgagatcgcaccactgcactccagcctgtgcgacagagcaagattccatctcaaaaaaaaaaaaaaagaaatattaatgtatttaataaatgtgtcataaattgaatgcctatatctgtaggccttttgttggtctctctgttctgttcctttgatctatttgatcactcttgtgccagtgccactagtctaaactatcataactttatagtagtccttgatagagaagagtagggcaaatcctcgccaatcttactctttttcaggaggaacgtattcttggttctttgttctcctatatacattttagaatcaatttaagctccatttttttaaattggcattttgataggagttgcattggctctctaaatccaattacagattagtgaagaactgacatttttatagtaacaagtcttttcaactgtgaacatcgtttatctctttatttactcagttaataaagttttgtggggttttttttgttttgacagagatcgcatacctcttttgctagatgtatattagaattattttgttttcagtgacccttagagacagggtcatgctctgtcacccaggctggagtacagtggcatgatcatagcttactgcagcctcctattcccaggctcaaacagtcttcctaccttagtctcctgagtagtggggactataggcacgtgccaccctgctcagctaattttttaaattttatgtggagattgggcgttgctatgttgcgcagactggtttcgaactcctggcctcaaactattctcccaccccaacatctcaaagtgctgggattacaggtgtgagccactgcacttgaccagaattttttttttttttttttttttttttttttgagacagagtctcgctctgtcacccaggctggagtgcagtggcacaatctcggctcacggcaagctccacctcccaggttcatggcattctcctgcctcagcctcccgagtagctgggactacaggcacccgccaccacgcccggctaattttttgcatttttagtagagacggggtttcaccgtgttagccaggatggtcttgatcccctgacctcatgatccgcccgcctcagcctcccaaagtgctgggattacaggcgtgagccactgcacctggcctcagaattttttttaaatcctgatttctttattgatgatatctagaaatgcagttgatttttgtctattggttttatatatagcagcattgctgattctctcattaacattctatatgtagatttattggagtttcctcatgggcagtcatatcctctgtgtgaatagtgacatttttttttctttccaatctctagctctttatttcttatacttgtccatgctagctaggacttctgtatagtattgaataaaagctacaatgttatacccttggctttttccttgatttaaaggaaattgactgaatggttctccatcaagcatagtgttcgctctggggtttacgtgtgtgtgtatattctttctgaagtaaaaattaattttcaataagaagatctagtaatgaagtataaaagaaatgctagtttacttcattcactaaatttttgttcaagtcttcttgtcttctgatagttgtcttctccttaacaaaaccccaacctttagccccaaaagatctttcagtggaaaaatatttgaatgttcaggggttataattttcatcttctacagctatgacttgaaaccctggctagtcaaaataacgcacaaggcatgacgtagaattttttgtattgcttgatcttctaatttatatgagtaaattatgggttttatatttatagataaagagaggagaaatcacttcaggtaagtgtacaaaggaataccactcatcttttaatgtaaaaaaattgttttccagataatttgcaaaattttataaaatttaaaggtttgcatttataaaatatgattgaattgtaaaaaatttatactcaatttatgtatactttaaggcactgcaggaaaggaaaaggaaaattttggacgaagctgtggaattaagtcaagatcactttaaaaaatacctagtaaaacttaagtcaatcaatccaccttgtgtgcctttttttggtaagttactaaatatggatatattttgagggtgagcgtgtgatagccaaaagagagcagtcttcagaggcatgttatctttattttatatctgagctcatctacttttattagctctctgtattaataaataataaaactctctattttctataaaatgaagactataatatctcatagggttgttataaataaggattaaaaatattttgtctgtactacctaataagtctagcacataggacgcactcatgaaatggtaactgttatttttatcataactatctatgtcacatctacagtgtttgctttctctttaatttattaaaagcttctatgtgatttttaaatttagaattaaaatattgttgtgtatgattgaaattgaatgatttaaatcaagttttgtcaacttcaacaattttggtattttgggccaaataattctttgttgtgatgggctgtcgtgtgcgtaataggatctgtagcagcatcctggcctctattcattacactccaatagcaccctggagttgtggtaaccaaaaatgtctctagacattcctaaatatcccctgggggactaaattgtccccagctgagaaccaccaatttaaatgaatcagcaattacgcatgaaaaagggactaaaaacttttttattgttcatgaatgagaagtaattatttttctatctaaattacagtctctgaaaaaacagaattagtttataagcctatagacttattaaccaaaattggcttaaaattaatttattaataatcacctaagatacttggcattaaatatttataatcaaatattaaaatatttggtcagaatagatttaacacaatttgcacttggtgaaattagagtttagaaaagcttaatttgccatttcttagattagcagcctttatttttgtacaagccagtagcttttattttctttttattttaaattctttctctttaaaaaatgcttaatggagagttaatgattgtttatcagagacttaacattttagtagtagagttgctgaatagtataggatgtctttcaactttactagatcagttgttttcccaaataattgattaaataacaaaatttaaaataacttttctttaaattctttttttttttttactaggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgagggtaaatattttctttgcatatctttagaagagaacgtgttaatgggtaccaaaaaaaaaaaatagaatgaataagacatactattggatcgcacaacagggtgactacagtccataataatttaattgcagatttaaaagtaactgtaagaggccaggcactgtggctcacgcctgtaatcccagcactttgggaggccaaggcgggcggatcgcttgagatcaggagttggagaccagcctgggcagcatggcgaaaccccgtctctactaaaaatataaaaaaaaattagctgggcatggtgctgggtgcctgcagtcccagctactcaggagtctgaggtgggagaatcacttgagcctaggaggggtaggttgcagtgagccgagatagcgccactgcactccagcctgggtgacacagtaagacttctgtctcaaaataataatagtagtaataactataagtatcggctgggcatggtggctcacgcctgtaatcacagcactttgggaggctgaggcgggaggaccacttgaggtcaagaatttgagaccagcctgaccaacatggtgaaaccctgtctctactaaaaatacaaaaaattagccgggcatggtggcgggtgcctgtaatcccagctacttgggagactgaagcaggagaatcatttgaacccaggaggtggaggctgcagtgagccgagatcatgccactgccttccagcctgggtgacagagggagactccgtctcaaaaaataaaataaaaaatattaactataagagtataattggattattcataatacaaaggataaatgcttgagggaatggataccccactctccatgatgggattattctacattacatgcctgtatcaaaacatctcttataccctacaaatatatacacctattatgtacccatgaaaattaaaaattttaaaaattaaaaaaaaattttagatcttgtgtgacctgtaagaaatatcataattatttgtcttgctatgaaaataatagaaaaaaattaatcagtagatagcatgttaaacattagacattctacactatctgcagttgttaatattgttactaagtactttcttttgaaagtattgcttctttgtgtagttggttcaagctacaccataaaaagtgaatgacaaagtagaatgatgtccatgcagtaaaaagaaaattcatttctagatttgatagccattttagataatgttacatgtagcaaaataacgttatataattcataagaacagtgtgtttaaataggaaaagggtcagcaaagtggtatatgtatgcctggcagaagatgatttttctaacatcctgtcgattgatgttctattttgagcaatagtgtgtaatattgatactatagtactataaaatatgaaacaaccttctaaattaaactatgatattatgtttatgctaaatgaatgttattatattatacttgaacttgggaacatattataactatcaaccagaataagtttacgtgtcatattaaaaactgcgctaaactttttagacataatctgcatgcaaattgggcatattgagtgaaaatatccaccattacttccaccctcctaaattatgagatagaaacttctttgttcccggttcaaaacaaagtaccctaaagtcctaagaaaaagaccacctaaagcataccatttataaaaatgataggtcgggcacagtggctaatgcctgtaaatccagcactttgagaggctgaggtgggtggatcacctgaggtcaggagttcaagaccagcctggccaacgtggtgaaactctgtctccactaaaaatacaaaaattcgctgggtgtggtggcacgtgcttgtaatcccagctactcaggaggctgaggtgggaggatcgcttggacccagaaggcaaatgttgcagagaactgagatagagccactgcactctagcctaggtgacagagcgagactgcatctcaaaaaaaaaaaaaaaagatacttgctcttaaaaaaaataaaggtggtaacctactgatggtgacctatttcatcccctctcaccattgaacccgccctctgtgatgtggggcttcggagagctaaggaaatatggtccccacaggaataatgttacactttaattcggtatgcttgaaatagtacttttagtatttatatctcagaaccatacctgctaattggtgtttgtggtgtggtctagggttcctaccaccatttaaagcatttttgggaggaagtgtcttctatatgattgagtcaaacaaaataaatttaaaatgtagacaaagtagctattcacttttcaaatcatacttaaataaatagtatttaaaatagagcaaaggatgaggaaatcaagaatactgctgttatagctttctgaaagcctttaattactagtggctaatatttaatttagctaacctgaacataagaacacattgtttcagtattgttaaaagagtaatacaattttcttgaaattggcagaatgccttaaaaatgggaagaattttatactagaaattttaaagctcattttgcctactgctaaagctaaaacctagtaccatttttatatatgcttctaaaccacttcaaaattaaataaagctaaatccagtaatttgctgctaaggaatttttctaaggaaatcataaaaaatgtacagaaaaatttatatataggagttaataaaaataattattataatagcaaaaaattagaaagtacctatatggataactagctatatggagattattacattctgaaatatccatctgatgaaatactatagagttaaaatttgtattttgtaaaataagcaaactggctgggtgaggtggctcatacctgtaatcccagcactttggaaggctgagtgagactccatctcaaaaaaaaaaaaaaaaaaaaaagcaaaccacattgaaaaaagttaattgaatataaacttcagaaagattaaaattgatatcccagtttttcaggaaaatatatatataaattattaataattatatataaatacatatatacatgcatatatttacatgcacagtaaaatcattggaagatagtctaatatttaaatgtaaacaatgatatttctggtttgtaagattactgtttctttttctttttttctctttttttggcagtgctaaatcacctgaattttctacgttaaaacttaaatttaagcttaaaatattttttgataaagacaaaaattttaaacattttatttattaggctttttttaagaggagaggtctcaccatattgccctggctggtgtcaaattcctgggcttaagcagtcccccggcctcagcctcccaaactgctaggattacaggtgtgagccatcatggcttggctcagataaaaacattttttatactagaagttagcacagataggtttaactttataatcattctttctttctttctttctttctttctttttttttttttttttttttgagacagtctcgctcttgttgcccaggctggagtgcaatggtgtgatctcggttcacctcaacctccgcctgccaggttcaattgattctcctgtctcagcctcctgagtagctgggattacaggcatgcgccaccacgcccagctaattttgtatttttagtagagatggggtttcttcatgttggtcaggctggtctcaaactcccgacctcaggtgatccacccacctcagcctcccaaagtggtgggattacaggcgtgagccaccgtgctcggcctataatcattcttgacattacttttaaagtaatttaaatgactacttttaaagtaaaaggaatttccagagtaattataaatgatcaagaatgatctataaattggattaacagaccttaatctaatttatctccactttttttctgattatcaaaacttcattgtggattataaccatagctttgttctaaacacttttggtagcttactagtgatgatcatttgttacaatgagtaggagtaaagtttcctaaggaataagtagtgctactgctgagccattaaaatgataataaatgaaaactcatattcttaatagaactttaagactagaatataacttccacagaaattatataatcttattcagaagtaaagagattggaataagcaacacttgtgaacttttcacatattgtgggctcttaatgtgttattttttagcattaaataagtaattttcagcaaaaaattttaatgagatcttattttaataagatctaaaatatatacttactatatatgcacttgtgttatttgtttaattccagagattctttgaaaaccttaaccccatgggaagtgcatctgaaaaagagtttacagattatttgttcaacaagtcactagaaattgaacctcgaaactgcaaacagccacctcgatttgtaagtcttttataatttcgggaacaagtgttctgttttttaaaatattattttcaatgtttaacaacctgttatcttaaaaatgtaattgaatggctgttcctaggtgttttgtttgcagtaatatactatttctaaaactggggggggaaatgtcagccttttgataaaatctggtttatgccttatcttggtactacttatttatgtgtctacttttgatccctcctagaataatacaaaaaggtgtgagaaagtgagaacttaataggtagctgaatggaacagaaaaaaaaagaaaagacctgggaaggagtaagcaaatgtattttggttcttgtgacttgatatgacttctgccattagggctccatggtccatagttgcctctggaacccatctctgtcactagaatttgatgctacaatttccagttactgcaggagtttgcagtggcaacagaagtagtagaagatgaactctaagtagctaaaagtgaagcaagatatagaaggaagtaaaaacacaaaccaactttaggtgaagcaggaagtcaggtagtttcatgctatctcatcttcacaattgtgtgatatatgaggggacttcaaaaagttcatagagaccgggcatggtggctcacacctgtaatcccagcacattgggagaccaaggcaggcagattgcttcagttcaagagtttgagaccagcttgggcaacatggcaaaaccctgtctctaccaaaaatacaaaaaaattagccaggcatggtggtgcacgcctgggggcggaggttgcagtgagccaagatcactccacttcactccaacctgggtgacagagcaagaccccgtctcaaaaaaaaaaaaaaagaaaaaagaaaaaagaaaaaaagttcatggaaaaatggaatgaaaagataaatttttttgatggaattaaaagataaacataaaaacataaactttatttcccaacataagcttcctcaagttcaggacacttttgtaagcgctaataccaaccattttgtccatccctaaaaaactaaagatcctgggaatttaaccatatcattgcagtctcttttacattattaactgaagaaaaatggttgccctttaatttttttttttataattaggaaacaaaaaaagtcagaaggagccaagtcaagactgtaagtggatgcctaatgatctgccatcaaaactctcaaagaattgctctggtttaatgagagggatgagcaggagcattgttgtggtggagaaggtctccttggtgaagctttcctggttgtttttctgcaaaagctttggctaactttctcaaaacagtcccatagtaagcagatgttattgttctttgaccctctacaaactcaacaagaaaaatgccttgagcgtcctaaaaaactgttgccatgacctttctttttgtttttgttttgttttttttgagacagagtctcgctctgtcacccaggctggagtacagtggtgcaatctcaactcactgtaacctccacctcccaggttcaagcaattctactgcctcagcctcccacgtaactgggataacaggtgtgtgccactacgcccggctaatttttgtatttttaatagagatgaggtttcaccatgttggccaggcatgtcttgtactcctgacctcaagtgatccacctgcctcgacctcccaaagtgatgggattacaggtgtgagccaccatgcccagccttttttttttttttttttttttttaatggcaatagagtcttgctatattgcccaggctggtctcaaacccctggccttaaatgatcctcctgcctcagcctcccaaggtgctaggattacaggcatgagccactgtgcttggccaacctttgctcttgactgatttggttttgctttgactggaccacacttccacctcttggtagccattgctttgattgtgctttgtcttcaggatgatactgggaaaccgtgtttcatttcctattaacagtttttcaaacaaatgcttcagggtcttgatcccacttatttaacatttcattgaaagttttgctcttgtctgcagctgatctgggtgcagtggttttgccatccatctagtggaaagtttgctcaactttaatttttcagtcagaattgtataagctgaaccagttgagatatctgtggtgttggctatcatttctgttgttaatcataggtcctcttcaattagagcaggaatgagattttttcctcagaaattgatgttgatgatctgccgccattggctttaccttccatatcatctgatcccttgttaaaaatgagttatcaatttgtaaacagctgatttctttggggcattgtccccataaacttttcataaagtattagtgatctcaccattcttctacccaagcatcatcatggatttgatatttgttcttgcttcaattttagcagaattcgtgttcctctgatagggattctttacaaaccgatgtgttatccttcttagtatctcaaactagatatgtttgagtatctcaaactagatatgtttgagcatctcaaactgttcagacatgttataataagttagtatgagtttattttgatggaaaaaaatgaaagtcatgcatagttatttcataatagacatttgccatgcactttttgaaaacccctcatagatcttattctcattttacaaaggaaaatagtgagattccaaggggttaaataagtttttcaaggctgcatagctagatattggcacagttgagatcttaactcaagttttctgatctgagttctgtgttttttatttgattactcctgccagaacttgaaaaatgggacagaggtgatggtgggagacaatgataggaattttctccaaagatttttaaagcatcaatgtagaggttgatcatttagtataggaaggggaaaaaatgatcttttttttttctgaagcatatagcataatatgtttcataaattatgttcccagtaaatgtttgtaaaatctatatagatattttcaaagagaagtttaggttcatatgttttaggagtaaaatgtgattttcacataaaatttcaagaattttatttctgcagtgctgaaaagagacttacttatattccaattcattttaaaattaagccagtcaaatccagaagattctactagaatgatacaggctgtcattgcagactgaaggactgcacgcttaagaactgtatgcttaagaactaataagactaataaggtagctctaagtcacagaaacaaattgttgtctatgcaaatttgtgacattaattatgtttgcttttctcagcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggtaagtatttgatgtaaaccgcttggtaaaaaaggaatcctgtgtctcagataattcttatcattttaattagggaactatagaatcctttgcaaactatattagtgtgaaaagtgatatctaaatgtgaaaataatgattaatacaagaagtagagcataatttgtgcattgttgatgcatattatcttctaatttactcattcaacaaagatttgtttagtaccttttgggtcccactaccagtctaaagggagcaatagatgatgaataagaaaacaaatagataagttctgtgatagagggggaaccacttaatgctaagaaggaaaaccattctagatacagaaggttctgagttaattttttaaaaaactaacatggcaaaagatgatgataaaattctgcactgtgtattacgtattatttatggaaacatttaaaaaataatacctacatgttaccttccttttcaaattaatttttcttattccaataggcagcaatagcatctttgctccagtgcttttgccacattcaagtaagtataatttaagttgattcttaatgaaatgactgtaaagataataatctggttgattatatttgagtattttgagttttggcaatattaaagaacaagaaaagttataaataaatttaattatttgcttacaactgtgtactacttaagcttcactatagtttattttcatcattttttatgatctgttctaagggctgtatggccttgaagaaattacttaccttccccacacttgttaaggattaaatgaaataactgtatagaacacctagccgggtgtggtggctcacgcctgtaatcccagcactttgggaggccaaggcaggtggatcacgaggtcaggagttcaagaccagcctggccaacatagtgaaactctgtctctactaaaaaattacaaaaattagccggatatggtggtgcacgcctgtagtcccagctactcaggaggctgaggcaggagaatcacttgaacccaggaagcagaggttgtggtgagctgagatcaggccaccacactccagcctgggcaacggagtgagactccatctcaaaaaaagaaaacaacaaaacaaacaaacaaaaaaacaccatctaaaatattgcttggcatagaatgaatagtaatttcatgtcagttgtctttcttccttacccttttcaaatcattttcccatggcaataatatagtaaatgtttatcaggttcccgggatatcctcagtcacttatttttttttacatcatcttatttaattaaagcagtaaattttaagtaaagcactattctatcattcctaattatttcataatttataacttttaatgctgtaaactttctttctgtggtcatttgtttaaaacaaaataactcaaaaatgaacacagcacctttgggtataattctctcaatctggagaacatctgcttcgagcatagtaaaatatatagtagcaagtttccctatcttatgagaaaaataagcttagtcttttaaatgtttaattttatattttaggttaaaaaatttttatctggccaggcacagtggctcatacctgtaatcctaccactttgggaggctgaggcaggagtatcacttgaggtcagggcaacatagcagttcaagactagcctgggcaacatagcaagaccctgtcctccctaccaaaaaaaaatttatcaaagtgacatattaatagaatttaaaagggaaatagtgctaagacacttaaaatgaaattaacagtggttctctacctcaagtctccccactccttttcttgttctccaaggacacttccacatttctaaatgatgtttttgtagtctctcttgagtcattaattttagacaatgtttactgatctcctcttatggtggatgagaatttcatgtctaccctgcctatacttaaccacatttggggcaaatattattcactgctatgcttcctttcttgtatagctctgtttcctggagttcataattgcctcattaatgtttagatttgtttgtttgtttaggtttgtttgtatgtttgtttagcacctttccatgccctttcatagcagttttccataaagtcaggcaaatcagggaacctagcagggttttcctttttcttttcttttcgtttccctttccctttcccttctttctttcctagaatcttccttcctggtgcctttttgtcccccgttccagtttggactggttgatattcaggtattgaccctgctgtcatcctagaactttctttcattgtcatcctagaaattccctttgcctccctcctgtgttggatccttgtttttggattcctcatcttctttcttgatatgctccctgattttaataggagtagctcctttagtagctacgtgagaaaagataatacatatgacttaaactttttaagttattgcatatatggaaacctattatacctttttttgtttattttgtggaagcctattatacatttaattgttaatagtttagctggaaatagaatgtaaaaaataatttgactcagaattttgaactcattttcctccacggtcttctgcctttcataattcctgctgaaaagtctaataccattcatttacttactcagtacataatttttaaatgcctgataatgtgcaggcactattctagatgtgagagtgatagcagtgaatgaaatagacaaatatctttctctcaatgatcctacagtttcaatctttttttaaacttagagcatacttaacagtagcagaggacccaatgtcatacagagggacccaaatatacagagccttaaatgaaatagaagtttattcctcacaatagccagagcaagtaagcaactctgctccactgggttttccagctaagcagggcaattcagaattctcaagatgtgacttccatctctgtcttgagtacctgctgtagttgttaccattttctggctagcaggaagatggagggcaaggagctttgttataaaaacatgatctgggccgggcgcggtggctcacgactgtaatcccagcactttgggagaccgaggcagacagatcacctgaggtcaggagtttgagaccagactgaccaacatggtgaaaccccatctctactaaaaatacaaaaattagctgggcatagtggcgtgtgcctgtagtcccagctatttgggaggctgagacaggagaattgcttgaacccgggaggtggaggttgcagtgatccaagatcgtgtcattgcactccagcctggggcgacagagtgagactctgtctcaaaaaaaaaaaaaaaaaaaaggagaccttcttagttacaaaggaagctaagaaacgtctctaactaggtagccatttgccttaccaaaattcatgggatcctattactaaaaggaaaaagggaaaggtgtactgggaagcagcaggctctgccacaatatgttgaagaaacttttaaggcattctctttattcttaataatctacagcttcacaatgaactgcattgatgtgggtatttttttttttcattttgtcatctacttaatgagccctttaaatttagagattcgagtgttcgatttccagaaaatgcttcctgttgctttggtaataatttttcccccagcatgttctctgactccttttgtggagctcctttttcttattctcatacatcctagattgatcctccaattttcttgtcttttatcacctcttgtccatctctttgtcttcttgttctgttttcctggaagatttcctcactttatctttcagctcttctatttattttcttcatctgtcataattttaaatttctaagaattcttttcagttacctctgattgtgcctttttttaatagcatcctattctaatttcatggatgcactgtcttatctctcttaggataataattatagtatttttaaattttatttttaatcgacagataattgtatatgtttatggggtacaatctgatgttttgatacattgtggaatgatcaaatcagctaagttgcatatccagtggctgggcagggttggaccaggaaaggggagactttagtcaatggatgcaaagtttcagtgactatagttaataataatgtatatctctggatagataaaagagaagattttaaatgttctcaccacaaagaaatgatgaatatttgagatgatgaataattacagtatttttgaaaaaaaatttgttttgtttctagtgttgtctcttttctgacctcctttcttgtattagttgtagtctcttgtctttcatattggaggctttcctttcttgtccagtagtatttctgttcatattttagaatgagggggaaactgatgggaagtgctgtatctatatccatggcacttattgacttgtgggtttcactgtagagtgatggaatgataattttttacttaggaaatccccaaatgttagaatctgtaggcattttctctaagaatgtttagtttctctaaagaaggatctttgaatcttctgcctggggcaatctcgccatgtagtatggatatctgtgttttcagctcagactagtatcccaagtctggggtttagattttccggagaataaaactgccagtctcctacagaggtgggaatgaggtcattgcctggcctcactaagtaggggagaggagaatggggttctaactctcccttatccagacttaaccaagtcttctgttttcatgtccatgccttcctttgtaccaaatgcctttagctcctgaatccttatttggttctgtggggcagatttgctgctgcttgtcagtattactctctgtagggtttcatcttcctccatctgtctccatatacattataatctaccttcatgaattaaagcttcagcttcatatatttcctggctttattgaagtttgttgatatttcttatttttcttgttgttctgtggtggaaatgtcattacactattagtttcttagtactgccataacaaagcaccacaaactgagtagcttaaaagagcaaaaatgtattgtcccacagttctgaaggccagaaatccaaaatcgagatgttggcagggccatgtttactctgaaacttggagaagagaatccttccttgcttcttctaccttctggcatttgctggcaatccttggcatctcctgatttgtagatgcctcacttcagtctttgcctccattgtcatatggctgtcttctcgcggtatgtttctttatttcttctcctcttcttataaagacactggtcatgtcatattggatttggatccattttaatgacctcatcctaacttcattacatctgcaaagactatattccaaataaggtcacaattataggtactaggttatgggacttcatcatatctttgggggaacacaattcaacccataacactgtgccatcgtagaagtaggaattctagacattattttgaatggtagtaaaatacattttccatataagaaaattttacattttgaaatttaatagaaaattgagaataactgcattaaattctgaatattctaaaataaatccccaaagaaaataaaatattcatagcaagtatgaaaagtactcagatgaaatgagaaaaatggcaagactccattcacaatgaacatgggtacttcacatcaaaggaagtataccttgtaaagaaacatagataattatagatagttcagcatcattagaaatctgaggaattttacacaatagtgagttgccattttagtcttttgaattaatgtatttttttttgttttagtacgagcaagcctatggtaaaaggcacattacttatccccatgtaaattggtatattagtataacccttttggaatctgaatacaacatatcaaaccataaaaatgttcacaccctttgatgttactgattcagtagataattgaatacttagtttgtaccagttaccctgctaagcacaagagattcagtggcaaacaagaaagacaacgcctctgccttttatttatacaaaatacccaataaatgtttggaaaaagttacatgcatgaagattcatcctactgtctcgtcttttcttccacttcacttgtcactgcttggtctctcttgctggttcctcctcaccttcccaaactattgacattggaaggccttaggactcagtttctggacctcttctcactcacttggttgttcagtcttgtatcgtttacatgatgataattcccaagtttatatctagccagaacctctcttctgacttctagactcatatatttaattacccatttaacatctccagttggatatctaataggaatctcaaaccttacctgtctgaaactgagcttcttattatcccctccaaagttgttcctctcactgcctcctcatctccattctaattacaagcatccagttacttaggctaaaaatagtgtaatagaagtatcttttacttctctccctttctcacacgccaaatgtgacctatcaacaaatcttgactactctcaaaatatatccagaatctaacaattttttgccatctccactgctgccaccctggtccaagccaccataacttttaccttgtttattacagtaagcatcctgacttattatcttctccacttcagtatgtttttagtagagcagccagaatgatccttttagaatctgagttagaccttgttttacttgtgcttaaagccctctggtgggccgggtacggtggctcacccctgtaatcccagcactttgggaggccaaggcaggcggatcacctgaggtcaggagttggagaccagcctggccaacatggtgaaaccccgtctctactaaaaatacaaaaattagctgggcctggttgcaggcacctgtaatcccagcatactcaggaggctgaagcaggagaattgcttgaatccgggaggcggaggttgcagtgagctgagatcacaccactgctctccagcctgggcgacaagagtgaaactccatctcaaaaaaaaaaaaaaaaaagccctctggtggctttccatctcactcacagtgaaagccggttcctttaaagaacgcacaggccctacacagtttgggcttgtttgatctgtcagacctcatcacttattctcccccttcactcagtctgcctcaacataatagacacattattgcatcagtgctttgctcttgccattcctgctgtttataatacttttcagccatttagcctcacagcctgctcccttacctccttcaggctgttaccttagtgaagccttccctaatcaccctatttatgttgctcccctcccacctctttctatacccctttccaaccaaatatttcttgtcataatttataggcatcatacttttacttatctttccctaacctagattataagttccataaggacgtgaatttttgagttttgttcacggttatattgctagtgcttcagacagtgcctgacagtattagcaggtgcccaataactgttgaatgaatgaatgaatggcagaaaattagaagtaacttagatagctaactaacattacagaaattgtttagtaaattctgctatattcaccagtttggaataaatgcaggcactaaaaaagttcataaagactgtagtcttgtagggaaatgctcttgatagacaattaaattgcattcagacttcagcaagggttattgattgcctaccgtggagaaatatactggttaagtggtgactgtagagtcagacccagattcagagctctcatagctttcccatcattcacatatcatctgcttccatgagtgtgcgtgtctgttaccacctaagactggcttaatcaataagaaaacactcagacatacttggaagcctagaggaaggctgctttaagactggttgattcagtgactcgatgatgtaattaaagaccagggttcctggactccagcctgggcgacagagcgagacaccgtctcaaaaaaaaaaaaaaaaaaaaaagcccagggttctttttcactcttcattgttttgtccagattatcagcttgatttaaagctgttttccctcaaaatcataactggcaagagcagtaaaggttgtgtgcttctttgttcagtcaaattatatatagagagaagtacagacaagacagtatgacagaatgcgtttccaaaaaagagcaaggaacttcctttccattagcccccagaatatctccttttaaatttcactggtctgaattaggttacatgcctacagttaaactcatcactctggctaaaggaatgggattactctgattgatttataccaattaggccccatccctggagctaaggggtcaggttcactttccctaaaaaaatggctacttgcatgaaagagaggtagataaaaatctgatcatgttaagaaagtgagtcccatgcctattccttgccttgaattggggtgtcctgggcaggattggccaactaaaccaaatgggacagatttaccaccaccgaaaggagttctcccaaagacgggacaaacaatgctggcaggtctgaggaacatcctctgcctaacctccccacaccatctgccaacctcataggcataccttttgtatcagctatttccccctgagccaacaggacacccccgcagaagtaactgcagagccacatgactgagatagcaatttttgacatagaataattagtttgacatatctacttggatgtctcataagcagttcagttcagagtgtttaggaacatcctctgcctaacctccccacaccatctgccaacctcataggcgtaccttttgtatcagctatttccccctgagtcaacaggactcccccccctcccccaggaagtaactgcagagccacatgatcgggatagcaatttttgacatagaataattagtttgacatatctacttggatgtctcataagcagttcagttagagtgtttaaagttaaacttatcaacttctttcccagttagcgcctgtgttcccaatctcagtataatgacaaataagacatagttgctgcctttgtaacaactgtgtgaatatagagagatcaaatgggaagttgaactatagaaaaaattaaaatgaagatagtaattattatatgtctggttgatctgtttaggggtattttcctgtcatttatcattttgtaaatttcctttaatgtagttatataacgtgtacattatcagtgagagacttgcaaagacaaagagttatgtgatataacactaccttatgggttcctatatggagggttttattacctgtgtggtgatgtgcccaatcatagctgcttcaaaaatatacggtctcgcagggcacggtggttcatgcctgtaatcctagcactttgggaggccgaggtgggcggatcacaaggtcaggagtttgagaccagcctgaccaacatggtgaaaccctgtctctactaaaaatacaaaaattagctgggggtggtagtgggtacctgtaatcccagctactcaggaggctgaggcaggagaattgcttgaacccgggaggcggaggttgcagtgagccgagatcgtgccattgcactccagcctaggcgacagagtgggactccgtctcaaaaaaaaaaaaaaaaaaaaaggtctctgattaggatggtctttctttggaagttactacagtgtatttagacatgttttgttttgatttgtgaaaggcttttcagggagcagaatctcattaatcataattaaatagtacaccttcatttagctgaagtacccatcatgccccaggcactatggttggtgctagagacacagaaataaatacacactccctgcagaaagcttacaatttaatgggggaagatagataaaccaatagttgatacagtctgacaaatgccatggtagaagtatcgatcacaaattgtgataaaggtttatcttatactgtgaattgtggttaaactagtctttttctcccccagagtctttctttagttcatgtggtagtttacataaactaagtgaagagcccctgattcctcctcctcttcctcctcgaaaaaagtttgatcatgatgcttcaaattccaaggtaatcaacaggactttactccaacttattcaaagttgtgaatcttcaaaataatgcctagtgttataaagagtctgtgaattatactttggctaccatttatggtttttcagcatttgggttgttatatttgaaaaatacttttagttgtttaatccttataaaaaccttttctaaataagaggctgggccgggcgcagtggctcatgccaggcgggtagatcacctgagatcaggagttcgagaccagcctggtcaacatgatgaaaccccatctctactaaaaatacaaaaaattagctgggtgtggtggcgggtgcctgtgattccagctactggggaggctgaggcaggagaagcgcttgaacctgggagttggaggttgcagtgagccaggatcgtgccactgcactccagtctgggcaacaattgcaaaactcttgtctcaaaaaaaaaaaaaaaaaaaaaaaaggctggttgggaggctgaggcaggcagatcatctgaagtcaggagttcaagaccagcctggccaatatggtgaaaccctgtctctactaaaaatacaaaaattagccgggcatggtggcgggcacctgtaatcccagctactcaagaggctaaggcaggagaatcacttgaacctgggaggtgaaggtaggttgcagtgagccaagatcgcaccattgcactccagcctgggcgacagagcaagactctgtctcaaaaactaaaaataaaaataaaaaaataaaaaagaggctggaagtacattttctttctggtacaggtggaaaaaaacttcagtagtattccaagtattcttcaaactttcaactaatgcttctcaaaattttaagggtgcatcagaattacctgaaaggcttggtaaaatcagactgtggagccacacctccagagtttctgattcagtagtctaggatggggcccaagaatttgcttttctaacaagttccctactgatgctgatgttgttggtctctggatcacactttgagatctactgctctaagcctcactggagaaagtagcagtagatgcccagtaagcagaagctagacattaaagtcctctagacatcatgtcctttcatgtctataaagcaataaattattgtcacttacctactattataattaaaatacataaatttctgaaatgtatacacaaagcaagataaagagttaggacctaagacttaaattaaaacatctcatatataaaaatattaaacccagccctgaattaatctaggagtactcataatctgataattaacccagattagtttattttgagcctctgaatttaacttgacaagtaagaatttttcagacttaaaaatttttttttttaatttttcagaatagaggtataatttaattacttttttttttgagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatggtatttgtaaagttttttttttaatttattcaaaaaaagacatagtattttagtactttttacaaataatgctcttacaaaaatgctactgatcaaataagcttttaagaattggaaaaataaaaatacaaaagtccttcaccattatcctcaggtgatcagtagcattgccttgtcttggatcctcagtgctgccaaaaggccagtataaagaatttatatttgcactgtaaactctgcaaaaatatggtttaaagtgacatgattgcactgaaaagggatagtgcttttgtgaaatttttcaaatttgagtaatagatgcctttttaaggcagtgaatttacacaaatatgggaggggtatatggtgttactgatttttaaacctctttgaccatcttctagtttttacttctagtttttacatctaggagaattgtgaataacaccaactgttcttaaactctttaatgccatgtcttaaatgccggtatttgctgctgaagacaaaaatgaaaagtaggatgaaaataatagaatggcactgtaagtgtttattattttgtcaaaatgtaaacaaagactacataacccaatgatggagggaaaaagggcatgtatctcattcagatgtgccttttgtttttgcagactatgacgtctttagctaatgaattgcctattgttatggaaaacagttaatatgccatgtatgtacagttttgtttatattgtatatttaaagatactgctaataacctatataaatttaagtgacttgaggcctataatacaatctgctactttactaattcataaattcaaaaaaaattctatggcataggaaccaactgccttgccttcaagacctagtaactttctctataaatctcgtgttaactgaaattttttttaaatatattttttagattggtaatatttaaaccagcaaatacttaaagctttattaaacattttaatcagataagtgagtaaagcttttatttgccatttggatgccttcgttcaaagtgatagagtgttttgctgatagtgctgtagcagcagttgtaaagtagccaaaagccacgttgtttatttactggtttgtggccttttactgtgctttgtatcagagttcttaacaagattaataaatcaccccagtcttaatttttaaaa

SEQ ID NO: 3 - DNA, 114449 bp, Homo sapiens
  source 1..114449: mol_type = genomic DNA
agaagcgggccagcgccgccgggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggtcagtgctaggggcggggcggccggcgggtggcccgtggccccccgagcttctaacggggagcaggtcgtccctcccacagggctcgagtccccggggccgagccgtttctcgttggctggcaatggggggctcacaattgcctgttgcattctgaaggacgtttctcaagttttttttttttgcctggtcccggaaggaaggttttgttatgatcataaaactggatttcatgttgcagtcatttcgtcaggcaacttccgccgttgaccaatttgttgtcctcaggctggaatcgggcaagagaaagtcccgctggtatttagacagtttctaaaacaaaagcacattttcaggccgggtaattacttttaattaagttctttgggagtgttccccctaggcggtttgcttgtcaagggtatccacttatgaggcaatggttttttgtaatatggatgtttcacatgtgtgaaatgtcagtgagtcataatattcttattcattttacagttctcaaggtaaatttaaagcgccttcccacttcctgcaaacggtgtcttacctgtttacaagagattacccttagaaaatttggtcagtgtcttcagtgtcttcacgaccaaattgcgatttaggacttgaaatcattttaaggaacaagaaaggggcaactcctgcaaatcagtctttcatgtttgggtgcattgctagggtgcatctttcctgtagatggtggcggtcttcctctgtgaatttaggtagtaaccatacgatcatttttataataaatccttctgtaagatcaagacatttaaagactgtgaataggtgcgtgatcagctgtcatgcctgttgagcaggggctttctttctttgccgttaatgcagacttagtctcttctgccttttgtgcaaaataaccaagaatacattctaaaataaggaaaaaataaagattaatttaaaagactatacttggaaaatatatcctcagacattaaatttctataaatgaaaggaagtagtgtattttaaagttaaagacattttcctcatgcgatgagagttgcagattttcccttattttcataattcttacaaggaagtattgctttcctcagggcaaacactaagtcgtatctttttaaagaacctggcagaaatgactagtggcagctagacagttattccattggtataccaagtgctaaagtattaaattgaccttacttccatgtgcagcccaattctgtaaggagagggaaagaaatgaaaagtgtgctgagtggtgaaaatgaactctggcctgaattaaaagcaaagggggaaatgcctagatagtaattagccctttgaccacagacaagtgtgagtgcagtaatcaggtaggcctatattgttggcaatgtgacgcaggtatatacccatttataactttctggtagcaaatagtatttgggtgtgtgttgcataacttgttcaataggtagctttgattctaataatcctttatgtccagaaacagatttatgttttctttttcttcaaatagagacagggttatgctatgttgcccaggctggtcttgaacttctggcctcaagcagtccgcccacctctgccttccaaactgttgggattacaggcataaaccacctcgcaccagacccagatttttttttttttttttcaagttaggctggagaagccaagattagcatccaatcctagtccattgctttggtgctattactttgcatttatattgtgcttgttttcctggaactcaggtgccttgtagatactatgttatattccacagttctagtatgttctttatgaaataaatacatctaagaaaatttggtcttttgaggtgaattcagaaaacattttctattaacttactgttgtgatagaattgaaatacatacgtatggaaaatttttttatatttttggaaaaattttggtaaaagtaattaagattatgtccacttttatggtatttaggacattgcaacttgtaggtctgtagtgcctgctaagagctgtagctcttagggagctaaaggttcactctttctttgcaggaagttttaaattctggtatgcatcagccaccttgtctttgtaaaatgagaatttctaccattttgggggagtctctgtcttcacattcagagcatctagaacttggcatccttcctctagctgaccagatcgttacaaagacaactaggatttgattggaatatctctctccttcaattggtgttgccattgtacatgtggtgtattctagcttcattaattcacttaaccattattgaacacattttacatacttgacatgatgcgggatcctaagagtacaaagttaaaataaaggcccctccaaagatgtataccatctaaaccaaaaattctaaaatttgaggttttggtttatgtaaatgagagcggttctgagctcagagttcagtaaggggtatttgtgtgtctatgaaagcagcaatgtagcttacttggctctgtcagtttagtccacttggacatcttggtggaacctccaaaactgttagaacgtaattttcagaaaggtaaagtcatcacttccatgcaaatgtaaatgaacatgtatcaattattttgattcagcccattgatgagggaactagtaagatgttaaagtcacttaatatgaaaatttgaggaggtatttataggcaatttaataagggaatattaagactgttgggttacatacagaattagttaataccctacaagaaacataaaagagtaggctttgggttatattttcctctggctaaaaattacttgcatctcagtgggcgtggtggctcacacctgtaatccagcactctgggaggctgaggctggtggatcaactgagtttaggagttcgtgaccagcctggccagcatggtgaaaccccgtctctactaaaaaataccaaaaattagctgggtgtggtggtgtgtgcctgtaatcccagctgctcaggaggctgaggcaggagaatcacttgaacctgctaggcagaggttgcagtgagccgagatcacaccactgcactccatcctgggcgacagagcgagactccatctcaaaaaaaaaaaaaaaattacttgcatctctatctgctgaaaagctgtaacttaatcttatagatgtgtaaaatagtcagtagaaattaataaaagattcaagcatagcactgtactgaaacacagccagtattcttttgcttattttccagttttggctagtttttatgaaaactggatatctatgtctatatccatgtatatatccatatatacccatatatagatccatatatatatgtatttgacaaagtcaccattgtcaacattgaaaattcaagggatttttaaaaaaccaatctcaagtattcattgcattacatagaaacacagagatgggctgggcgcagtggctcatgcctgtaatcccatttgggaggccaaggcgggcagattacctgaggtcaggagatcgagaccatgctggctaacacggtgaaaccccatctctactaaaaatacagaaaaaaacccaaaaaattagccgggcgtggtggcggacgcctgtagtcccagctactcgggaggctgaggcaggagaatggtatgaacccagaaggtggagcttgcagttgagccgagatcgcgccactgcactccagcatgggcgatggagtaagactctgtctcaaaaaaaaaaaataccaaaattagccaagtgtggtggtgcatgcctgtgatcccagctactcgggaggctgaggcagagaatctcttgaacatgggaggcagaggttagagtgggctgagatcgcaccactgcactccagcctgggcgacagagcgagactctgtctcaaaaaaaaaaaaaaagaaagaaagaaagaaaaagaaacacagagatagacaaataggtttatggaaaaataattttgggaatagaaatgtggtgttctttagctttttgcttgttcttaaacttttaaaatagaacctcacctagatcatttaaaaacagagagctacaaagcagagtgaaatgacactactaatggataatgcatggattgttaacattactgctaaattatgtatcttccctaaaagagcctagaacataattgccttcaccactgctccccaagatcattgaagctattgtgttacttggggaaaaaagagcatggtgtatatttgtaaatgcagtttattacctgtgtcgttgaaatcccttggtactatatgcatgtgttatttgattatatgttgagataaatcagcattcttcatatgggaaatatgcctcaaaatcattttatcagattttacagtccctgatatttattttgtagatgtcttttctgtaaggtgtttttcaccaggctagccatagaaaagaacatggctgttttcttgccagctgtagttaaaaatgtcagagaaagctagaaagaattggttgaattactttgttcctgagtccaattagattcaggttaaatatcgacctccccaccctgtgacaatttgctcttagatatctaaaaggcaagaggtgtgagagaatgtctgggttaattaatagcagtctacggcaaggaaaaagatcggtaggggctttgatttaaaaatggttttgtgaagttctactgagatcctagtgtttctgcgtttgtacaaatgtctcttggaagtttgttttagaagatggcactggatctttcctgaggcccacaagaaaagtacagggtgatctgagaaaatataactggtgtcattgatatatgagagtcaaagaagactttaagcaagcaacatttgtgcttctttctggattatatattcaaatatagtaatattactgtctccaggctggtcttgaactcctgggctcaagcgatcctcccaccttggcctccaaaaatgctgggattacaggtgtaagctacgtcgcctggctgcagacactgttcttgatacggaagatgtagcagagcccctgctgttataaagcttgtgttctaagtggctgtggcagagagacagacaataaggaagtaaacaattatctgaaagatcagtagaattaacaagaaaaaaaaagggcgggggggaaggatttgaggctgaggggaaagtaagaacatgatttgtttgtttgtttgttttgaataggtctcagattctgaatttaatgacttattttaaaaaacaagaagaataagtggatgaagctagtatggtagactgtaggtacactgagttaaggtctctgcctgagaataggaagtcctgttgggttctcatttacatagcaaagtaattagattaacttgatcagaattgctttttgaaaagattacttcaagtcaaagccaaaaactaataagagatcctgtgatttttgtgacatgagcctgttctggaattcctaaagccgctgaatgtaacagtagaactcgagggagtcatttggaattattccaaactaataatgacccaaactgacccgaagagttcagccagaactagatgagcggtaggaatgtactttaacttgctgtacttggctccctgtcagcaatgattaagtagccttctatttttggtttaattttggtatggtatatttggagcaataatattccattaaagtgttttatgctgagtattcaaagcattacctgtgttaccccttgacataaatcaactatatgtcttttgtattaaccatggactctctttcaagggaacagtaatttgattatatcctgcatatttgaatcaaaaggaattttaatgtaactagtggatttagcattatctcatgttaaaaattaacaaccaaaaattattttcttccatgggccaggtgcagtagctcatgcctgtaatcctagtactttgggaggctgagatgggaggattgcttgaggccaggagttcaagaccaacctggccaacatagcgagaccccatgtccataaaaaattattttcttcttttacataagaatatatgctagtacaaagttttttcaaatggataaagtattacacattcacattttaacatgtagaagtgaagcaacaagatgaaaataataccaagatctagatataaggactagtattagctcttctaagtaaagttttctgtactccagttttcttcctcattaggtcattttgtaaactcaaacactatttctctctctctctctttttttttttttttgacagggttttgctctgctacgcaggctggagtacagtggcatgatcatagctcactgcagcctccaactcctgggctcaaatgatcctcccactatagcctcctgagtagctgggactacaggcatgtgccactacacccagctaattttcttattttttttgtggagacaaggtcttgctatgtcctctggctggtctcaaattcctggactcaagtgatcctccagccttggcctcccaaagttctgggattacaggagtgagccacctgcctgccaaaaactacttcttacatacaaagtatattatagttctttcttaactgacctattagcagcatttgacagttgatctcttctttttttgaaatcctttcttcatttggcttccagaagaatatcaagctttcagggattttttttctctgaatattccttctagtttcccttcccttgattcctcctcatctttctgtgaccacatccttctgacctccccagagcccatttatatatatgtgtgtgtgtgtgtgtgtgtgtgtgtgtgtgtgtgtgtgtgtgtgtgtgtatatatatattttttttttttcctgagacggagtcttgctctgtcacccaggctggagtgcagtggtgcgatcttggctcactgcaacctctgcctcccaggctcaaccagttctcctgtctcagcctcccgagtagctgggattacaggcgcgcaccaccacgtctggttaatttttttttttttatatttttagtagaaatggggtttcaccatgttggccaggctggccttgaactcctgaccttgtgatctgcccgcctcggccccccaagtgttgggattacaggcgtgagccactgcgcctggccaatttttagacttctatttctattaacacatcctcctttggagatgccatcctgcctcattgcttcacgtataatctaaatctgataattaccaaatttacatttctggctcagacctctttcttaaacatgaatgttcaactctttttttgagacagggtcgcactctgtcacccaggatggagtgcagtggcaagatcacagctcactatagccttaacctcctgggctcaatgatcctcccacctcacccccctgccgcccccatatagctgggactacaggtgtgtgccaccacacccagctaattttttgtttgtttgtttgttttagatggagtctcgcttttttgccaggctggggtgtagtggtgcaatcttggctcactgcaacctccacctctcaggttcaagtgattctcctgcctcagcctcccgagtagctgggactacaggcgtgtgccaccacgcccaggtaatttttttgtatttttagtagagacggggtttcaccatgttggccaggatggtctcaatctgttgacctcgtcacctgcccgccccggcctcccaaagtactgggattacagggatgagccaccacgcccagccccaatttttaaaaaactttttgtagagacagggtcttactgtgttgcataaactggtctccaactcctgggcccaagcattcctcctgcctcagcctccaaagtgtttgagttacaggcatgaagcaccacacccggccaactttttacttgatatttccacagaggcatctcaaccaacactgtatccttttcttcccctgcaaacttgtttcttttgtagtggttaacatatcaataaatggctactccatccttccggttgctcaaactaaaaatcttaagttattcttgaatattgtctttttttataccacacatctaatttgtcagcacatccttttagctctacctcaaactatatatttagttaccgttttatactttttgacttttaccacctggaaccaagtcatcatcaccaatctcctggaatattgaaatatcttttcaactggtctctgatcatctgctcttgtcctatttagtttctttttctccccaaacacaaagagataagtgagatcatttcactcctttgttcaaaaccctctcagtgcttctcagaataaaagtcaaaaaagtcctcccaaaggtttactaggccctctgcagtctagggctgccccacctcccgcttttacctctctgacctctttaatattgtcccttgtttgttctgcttctgccccatactggctttcttgtttctataacgtagacatgttttagtcttaggacttttgtacttgctgaattttctacctgaaacacccttccctcagataatcacgtggctggcccttttacctcctttaggtctttatagtcagacatcattttcttggagagattttctcttacagcctatctaaaactgctacatcctcctgcttcccagacagtcccacatcagtgttcacagtattttttcccataaacctgtatctccaatataaatgatgtatccagttctcaagccagaaacctagtcatcattcttcccctctttctcatgccaggctaacatgtattcatcactgaatctacttgattctttctcctaaattaggagttttctaactttttttgctgtgtatccccaaaagaattttgaaaaacttgcacatttttatgctgacatctagaaattttcattttacatttaaatagttgcagtagatgtaatttcatatgtgttataaatactgatgttttaaggtaaaacagttgcatcagtcttttaaatgtgctgaatggaatttaaataccaaaataatttgatatccaccatcattttttaaaaatacacatgaaaagtgtgtctttaaaagttggaaattttacattgtcctttttttctctgtgaacttttttcattatatttcccctgcataattctaatatgatatttttagatttaagtctttaatcgcacttttttatttatactccttacaacaacaaaaaagtctacatattgaatttaaaaggattttccctacaaccgtaaagctttaaaacctgtcttttgaactgaattattattattattattattaaagtctcattctgtcacccaggctggagtacagtggcatgatcatggctcactgcagcttcaacctcccaggctcaagcgatcctcccatttcagcctcctgagtagctaggactgcaggcacatgccaccacacttggctaattttttaaaaatcttaaagatgctttctttttattttcatgggcctgtcccctcaggaggatgtatttttccactaggctagaggatggaagaggcaagatacttaaatgaaaatatttgtaattatctctttgtttagtgtctaggatttatttattgcacttcagagcaacatgtatcctatagagaatttcaagataagtgagagatctgcctttcttagtaaaatgagagggcaactgtgaaaacaggtataaaaggagaccctgctttactcactgtgtgcaggcaccttgtcaggcagatcttctttaggaaagagtacatatggctgtttagaaagtgtcctgacagacgtgggtgtttggcctgggaatttattaaacataagtgaatgaaacaaatttaatagcgatcttttcccagttcacaggggaaaaaaagcaattattttttcaattttatttttcttccataaattagaaaaaaaaatctttgttgtctgctgcaatttacttgctagtgagtagtgaaagattgtaaaataaatgagcgaatgatcatggaggttttaaagggaaaatggcttttaatactttttggtttttttcttagaaacatgttcctgtagtttgattttaagttttaaagtcattactagcattgtccctgctgtgatagaatatgagtcttaaaatttcacgttctgcaaagaacactgatttccaaatgatctgccactggaacaaattgggaaccatttttctagcctgtactgtcttgggtttacaagcaaatgacctgcctttatgggaaggtgcttctgggtcataggccattcaaagaaaactttgatgacaaaaatttttgcttcagctaatcttttttacatatttgattatattatggtaagctctcacctaatattaagtagaaatagcttcttggcctgtacttatctgcattttaaataaacttacattgtgaaagcctgctgaaagtacctaattaagagcatggactctgagaattattaatggacagtgggaggaatagagaaacgtaagagagggaattccttcatttataatgttgtatgagaaccaggtctccagatacatttccagtgaaatgaaaacaaattttatggagtttaaaattttttccagtatccagataatttcagtgaggccaagagatctgtttgctgctgtgaatctatttaacaagtatttactgagtgctttctttatgcagggtctgttctttttttttttttttttgagatggagtctcgctctgtcgcccaggctggagtgcagtggtgctatcttggctcactgcaagctctgcctcccgggttcacgccattctccttcctcagccaccctagtagctgggactacaggcgcccgccaccacgcccagctaagtttttttttttgtatttttagtagagatggggtttcaccatgttagccaggatggtctcgatctcctgacctcgtgatctgcccgcttcggcctcccaaagtgctgggattacaggcgtgagccaccgcgcctggcccaatgcagggtctgttcttttaatgacatactagattacctgtatgctaagcatacaggtgtagggaaataggaggaggagaccgaaaacaagaaatgggagctggtgtggtagtgcccacctgtagtcccagtcacaagggaggctgaggtggaaggatcacttgagcccaggagttcgaggcttaacagtgagtggtgatcacaccactgcactccagcctgggtgacagagcaagattctgtctccacacctctcccctgccccccaaaaaacaaacgagaaatggttcctgatcttaatgagtttagagtatgcagctgtggtttcaatttttaattatacactttgattagaaaaatgttgccttagaatattatattttagaattattttttaaaaccttactgggatgtaattgatataaagtatatatttacagtacatatatttacaatgtacaatttgatgttttcaacaatgtgataagttatatatacacagtaaaaccatcccagtaaagctagtagacatatccttcagccccataaatttcctcttgactgtaattctccctcctatttctccccactctcaggagacatcccaagccatcactaatctgttttctgtcattatcgattgcattttctagagttttatattaatactgatagaatcatacagtacatactcttttttttcaatctggctttcagcatgattattttagattcatttatgttgcatgtatcaatagttcattcctttttattgctcagtagtgtattccattgtgtagatatactgtggcttgtttatccattcacttatttatgtacatttagtttttcagatcttggctattcaaataaagctgctatgtatatttgtgtacaagtctttgtatgaagatatgtttcaatacaaagaatggaaattgctggtaattaccaaagagtggttggatcggatagtaggtggatgcttaacttttttttttttttgagacgaaatcttgctctgttgccaggctggagagcagtggtgtaatcctgactcacagcaacctccgcttcccgggttcaagtgattctcctgcctcagcctcctgagaagctgagattacaggcacgccccaccacgcccggctaatttttctatttttagtagagacagggtttcactgtattggccaggatggtctcgatctcttgacctcatgatccactcgtctcggcctcccaacgtgctgggattatagccatgagccaccacgcctggctgcttaactttttaagaaactttcaaactgttttctaaagtggttgtatagttttacattcccaccagcaatataagagatcctgttcctcctgccaatacttggtaatttaattttagccattctaatagcagtgtaatggtactttgtggttttagtttgcatttccctagtgattaatgatgttcaacatctttcatgtttttatttgccttccatatatcttctttggtgaagtgtttgttcagatctttggcccatttttgttgagttgttttgtttttttgtttttgtttttgtttttttttggggggatggagtcttgctctgtcgcccaggctggagtgcagtggcacaatctcagctcactgcaccctccgccttccgggttcgagcgattctttcacctcagcctcccaagtagctgggattgcaggcacccaccatcatgccctgctaatttttgtatttttagtagagacaggattttgccatgttgcccaggctgatctcaaactcttggcctcaaggaatccacccaccttggcctcccaaagtgctgggattacaggcatgagccatctcactcggccttttttttttttttttttttttccttttatcgaagtttcattatataccattctcttaatactatctttttatctttttctttctttctttttttttttttgtttttaagagatagggtcttgctgtgttgcctaggctggtcttaagctcctggcctcaaatgatcatcctgcctcagcctcccaaagttctgggactacaggcataagccactgcacctggcctatactatcttttggagaccaaaagttttttttgtttgtttgtttttgtttttgtttttttgagacagagtctcgctctgtcgcccaggctggagtgcagtggcacgatctcgattcactgcaagctctgcctccgggttcacaccattctcctgcctcagcctcccgagtagctgggactacaggcgcccgccaccacgcccagctaattttttgtatttttagtacagacggggtttcaccatgttagccaggatggtcttgatctcctgacctcgtgatccaccggcctcggcctcccaaagtgctgggattacaggcgtgagccaccgcacccggccaaaagttttaaatttttatcaatttgtttttttagggactgtgccattagtgtcatatcaaggaaatctttgcctaacccagggttacaaaaattttcccttctagaaattttttatttatttattttaattttcaaaaatagagacagggtctcactatgttgcccaggctggtctcgaactcctgatctaaagtgatcctttgtccttggcctcccaaagttttgcaattataggtgtgatccaccatacctagcctgttctagaaattttatagtttaaattttatatttatatctatgactcatttgaatcactttttcttttttaaaaaaatctcaccttgtcttatggtgctgattgaatcattttatatatggtgtgataattctgtatatggtatgtttgtttttttgtatatggatatctggttgttctgtcaccatttattgaaaaggctgtccttttcctttgctaaaggtcttcatgcttttatttaaaaaatcagttgcccatatatgtgtggttttatttctggattctctattctgttctattgattgttttccttatctttatgtcagtgccgtactgttttggttaccatagctttatagaaatccttgaaatcaggtagtgttagcccttcaactttgttcttctttagagttgtttcagttattctaggacctttgtatttccatgagaatgttttaatcaacatatcaatttctacaaaaaagcttgctggaattttgattgagattgtgttgcatctacagatcatttgggaggaattgacatcagaacaatgttgagtcttccaactcatagtttaatctcttcatttatttaagtctttaattcctatcagcagtatattgtatttttatttttatttttatttattcatgtttattgtattttgtttttattttttgatattgagtctcactctgtcacccaggctggagtgcagcagcacgatctcagctcactgcaacctctgcctcccgggttccagcgattctcctgcctcagcctccagagtagctgcccagctaatttttgtacttttagtacagacggggtttcaccatgttggccagcctggtctcaaactcctgacctcaggtaatctacctgccttggcctcccaaagtgctgggattacaggtgtgagcaaccttgctctgccagtattttgtagttttagtatatatacttcaactaaaatttttattttctttttaaattgaattttaatatttcataatgggctgggtgtcgtggctcacgtccataatcccaacactttgggaggctgaggcaggcagattacctgagctcaggagttcaagactagcctggccaacatgatgaaaccctgtctctactgaaaataccaaaattagctgggcgtgatggtgcacacctgtagtcccagctacttgggaggctgaggcaggtggatctcttgaatctgggaggtggaggttgcagtgagccaagattgctgccactgcactccagcctgggtgaaacagcgagactccatctcaaaaaaaaaaaacaaaaaaaacccaaaacatttaataatgaaaacattgccagtattcttaattgatgtttgagatatttgcatccttgtggaaatcttggcagcacaatgaagaatttggcaaaaataaatatcagtcagactctatatccaaaaggatttatttccacattgtacctgaaactcaaatgttaattactgaacaagtgcattagcaagatttttaatttaaatgtgaagatggaaaactgaaaaatataaattaggaaataacatttctataacttgtcaaatgtagtggtttatcagggtaaaaagttaaagtgcttttgtgtgtgtctacacatggatttatagtatgagactattttgttttttgtttttttttattatactttaagttttagggtacatgtgcacattgtgcaggttagttacatatgtatacatgtgccatgctggtgcgctgcacccactaacaattctatttatagtgttacagtaaggaaatgccttctggcaatttgaaaatatggtgtaactaaaatacaggtctgacttgttaatctactgttaaagactggaaattattttaattgctctttttctgactaggctttcaaaaaatatgataggcaaattggttctgtcgtggtaattttatgtttactgtctctgtagaagtgtaaagcatggttctcttccattgtcctcttgatgtcctgttacagcatttatgggtgagattttaacattgtgtgtttatttttatgactgttttcatatttgaaattaagaagtttggcataagaaactttgatgcttgatgttcaaattgctttgtagcttatttaacaaaatcataatcacagaaaaagaatccatcccagttagacattatcttaattctcatgttcaatcattttcactgagtggggcccttggctttttatggaaagatgttataagaaacaaccttgccgggcgcggtggctcacgcctgtaatcccagcactttgggaggacgaggcgggcagatcacgaggtcaggagatcaaaaccatcctagataacacagtgaaaccccgtctctactaaaaaatacaaaaaattagccgggcatggccgtgggcacctatagtcccagctactcgggaggccgaggcaggagaatggcgtgaacccgggtggcgaagcttgcagtgagctgagatcgcgccactgcactccatcctgggggacagaacaagactccgtctcaaaaaaaaaaaaaaagaaagaaagaaacaaccttgcctcagggaggggggcctgaggaggcaggaggattgtttgagccaaggagttggtgaccagctcgagcaatttaggtaggcctcatctttaaaagaaaaagaaaaaaaaaaaaaaaaagaaacggccttatgaagtctactgccacacttacaatgtaaatgtttatttatttatttaaagatggagtctcattatgtttggaagcctgaaactcctcggcccaaggaatcctcccacctcagccactagagtagctgggactacagacaccccactacgcctagttaaatgtctacttttttaaaaatgtcttttaaaagtcgattgatctattagaaatgtatggctaaaatgtaattaagttatctctggctgtgttaaagaagtgcagggtataagaggaaatatttatttctccaaaacctaatttgaatttattagaaaatatgttagaaacatatttctaacatagaaatacattagaaagcctgattttttttttttattattggtcctatatgaatttctaattgccttactgctagactttttggaccagacttcttcaaagagtagtctttccttactatggccttccacttccccattccccaattcaaaattatttttctttatcaattagtttgtattttgtcaaaattatttatgtaaataaaaagataattcgctctgcaaagcttgttatgaaaaatagcattacttcccccttaaacacaaaattttctgtttcctagagaaaaccattttaacttttcaaagtgatttatttacttctatatttctaagaaagaaaaagtgcttatattgctatttcatgtttttttctgttttggatgttatctgttgacttcctaccacggagggtaaggatttaatattctcttttttctctttttttttttttttcttggcagggactcactctgttgcccagactggagtgcagtggcacaaaggatttaatattctttaatatgcacatacattcccctccaaccacacacacactttccactttctcttcccccacttcaaagttatatcttaatttgagttggattaatattcaaagtttacattattatgactgtaaatgctatttttggggtttttttttggggtgggggggacagggtctcactctgtcggccaggctggagtgcagtggcacaatctccactcacctcaacctccacctccagggttcaagctgagattacaggcacgcaccaccaggcccagctaatttttgtatttttagtagagacggggtttcactgtgtaggccaggctggtcttgaactcctggcctcaagtgatccacccccaccttggcctcccaaagtgctgagatcataggcatgaaccaccacacccggcctataaatgctatttaatctgctttttcttttctaactcactgcttttactggagttattaattatcttgttttcttgtttgtgtgtttttctatgtagtacacttattaccaaattcaaactttttaccagttttctaaatatcctatcaagattttcatcccattgcatactctgtcaagtttgttttcttgagacagtctctcccagagccttctgacctgcaccagtgtggactggtcacctttattcctgttttacagctctcatcctataatttcctttcattttatcctgggcattcctttgacctttcttctctattgattcctttattttctttattccatatttttctttcttgattcatacccttgttttagtgtagtacaaatgacagaaggttaatgagaaagactacgtgagagataaagttttggaccttattctatctaagaatgtcacgttagcatggcgtttgatattgctggtatcttggattccaggctgaacatcattaccatctagcttctagtattactgttgaaatctgaagctaatgtctgcttctcatatataatctgctcctcctcacttccctgtcctcccagtcttgtaggatattctctttgtctccagggtcctgacattaaaattttgttcagtgacatgggcactagaaaagccctttagacttattttattgataatttcccccctcaatttcctctgtttgctagatgattctcaaacttttgaaaacctcatttatggtgaagtgtaacatataatcagaaaatgtgtaaaggataaatatacagtttaaggaacacctatttaacactcaggtaagaagacagaacattgtcagcacttttctcaggataactctccaaaaggtaaccgtttttgtggtattcactgttttgattttctttctttttgagacggagtctcgctatgttgccaggctggagtgcagtggcatgatctttgctcactgcaacctccgcctcctgggttcaagcgattctcctgcctcagcctcccgagtagctgggactacaggtgtgcaccaccatgaccagttaatttttgtatttttagtagagacggggtttcaccgtgttggccaggatggtctcgatctcttgaccttgtgatccgcctgccttggcctcccaaagtgctgggattataggcgcgagccaccgcgcctggcctgttttgattttcttaatagtttttccatctcagcgtgtatcccttaacaccattgtttaatttgttctgaatttgtttattttttatttttgtatttaattttgtctgactttgtgaatggaatcccattgtatgtattctttttatctggcttctttctgccaacattttttcagggtgcatccacattttatgtagctgtcattattactgcatttttttgactgtgtgtattccattgtattaataagccacaatttatctgtcccattctggatgaatatttgaattcttttctagttttggaaggtattattaataatgttatttatgagccttctagcgtatgtcttctggtaaacatttctctagagcattgctgtctagaagagatacaatgtgagccacacatgtaatttaaaattttccctcctaggctgggcatggtggctcatgcctgtaatcccagcactttgggaggacaaggcaggaggattgcttgagcccaggagttcaaggccagcctgggcaacacagcgagaacctgtctcaaaaatctaaataataataataataataattaattaaaaaataaataaaattttccctcctgagtgaattaatgcaggaacaaaaaaaaaacaaatgctgcatgttctcatttacgggtgagagctaaacatggggtacccatggacataaagatgttaacaacagacaccggggactaatagaggaggtagtactatgctcagtacctgggtgatgggatcatttgtaccccaaacctcagcatgacacaatatacctaggtaacaaaatctgcacatatacccccttaatctaaaataaaagttaaaaacgaaaattatcatagccacagttgaaaagtaagaagaaacagatgaagttgattttaataacatatttttaacccaatctaatcatttcagcatgtgtcataaaaattgagaatttgacttcttattttaatactgaatccttgaatctggtttgtattttacaccaacatcccatttcaactcagtggagctacatttcaggtgttcagtacccacatgaggctagcgtctattatattggactgtatagctctaaagaaatatatgtaaatctatcctgaatatatatatatatatcctatagtggaattgctcagtcatagactatacatatcttgaactttagtacttaatggcaaagtttttgaaagtgattgaaacattttacattccagtagcagtgtgtgatcgttcccattgctccacatagttaccaacatttgatattatcagaatttttagttttgctgcctggtgagtggatagttttcatggtcgtttaatttacatttttctgattacttaagagctagagcactttttaatatatatataggctatttgaatttattcttttgtgaagtgctagtttaagggttttttgcccattttttctcttgggatttttatcattttttttcttactgaatttttaggagttctctatatattctagatatgagccttttgttacatgtactacatatatcttctccaactctgtaacttgcctttttactttcttaaagatgtcttttgagaaacctaaattttaaagtttaatataaagtttatcagttctttccttcatagctagtaattttttgtgtcctatataagaaatctttttcaatcctgaaatcatgaagatattatctagttttacactgtcagagctttattgggtatatttatttattaggcctaacatgcagctaggattgatttttgggtaaaggttgaagtaggagttgattttctttttctgcagtggttcaacactattcatacacttccctgcctccctgcaactctctgccacacctcatactctacagtgccatctgtgtaaataagcgtctatatatatgtggacttgtttgtggactctgttatgtcccattgatttctttctctatccttatgccattgtcacattcttcattactatagctttgtaataaatcctgacaaccattggagcaaatccttgtacttccttacagacatatgactttgttgttagtaattttaaaaaaagaatatatgactgattttcttagctttttgcacttttatttacatgttgaaattatcttggcatttttagcaaaacaacctgcttggatttgattgtgattttataactgcatgtatcaattttgagagaattcagttgtatacaatattaagtctgacagttcaccaacatggtatcatctttcatttatttagctctttaatttttcttaaagtctagttttctccctaggagtcatgtgtaccttatcaggtactcaaggtacacggtattttaaattctactgtaaatgctatttaatttttttttttttgagacaaggtctcactctcacccaagctggagtgcagtggcataatcatggctcactgcagcctcgacctccgggttcaggtgatcctcccacatcagcctcccgtgtagctgggactacagttgcgtgccaccacatctggctaattttttgtagaagtggtgtttcaccgtgttgcccagactggtcttgaactcctgggctcgagcgatcctcccgcctcagcttcccaaagtgctgggattacaggagtgagccaccgcacctggcctaaaaattttgtttgctagctttgttgctggtacatagaaagaaaagtttattttttatgagttcaggtaatttatgtgtacaatatttttgtcctgcatgggtacattattttgtcctccatgggtgcatggattcttcagagaagcagaaccaataggagacacacacacacacacacacacacacacacacacacacacacacacacgacatttaaggaaataggctcatgaggttatggtggcccagaagtccaagatctgcatttgtcaagctgcagacccagaaaagccaatggtataattctagtcctagtctgaaggcctgagaaccagaagagctgatgatataaattccagtctgagtatcagtctgaaggcagaagaccggtgtcccagctcaaatacagtcaggcagagagaaagaattctttctcagccttttgttctattcaggcctttagtcaagtggataaggccacactggggagggtagtctgcttttctcagtctaccaactcaaatgttaatctcctccagagataccctgacagacatacccagaaatagtgtgtaaccagttatatgggcaccccaaaattaaccatcacaatgggcagtcagatgatctgcaaatttgtttcttctttaccaattctgaaattttctttttcttggtttactgcaatagccaggacctccaaatataatgtggaatagaaatgataatagaaaatatccttttccttgatctccaaaggaaagctgtcagtgtcttgtcttactattaactatgattttattgtagctttttttgttttgttttgttttttctttgagatggagtcttgctctgtcgctcaggctggagtgcggtggcatgatctcagctcactgcaacctctgcttcccagttcaagcgattcttctgcctcagcctcccgagtagctgggactacaggcacctgccaccacaccggctaatttttgtatttttagtagaggcggggtttcaccgtattggccagggtggtctcaaactctgaccttgtgatccccccgtctcagcctcccaaagtgctgggattacaggtctgagccaccgcacccagcctattgtagctttttagtatacatcctttatcaaatgaaagaagttcacaaagagattttttatttgtttgtttgagacagagtctcactctcacccaggctggagtgcaacagcacgttatctcggctcactgcaacctccgcctcccgggttcaagcgattctcctgcctcagcctcccaagtatctgggactacacgcgccttctaccatgcgtggctaattttttgtatttttagtagagatgggatttcaccatgttggccaggctggccttgaactcctgacctcaagtgatccacccgcctcggcctcctaaagtgctgggattataggtgtgagcctccgtgccgggcccacaaagagattttatcatgaatgaatgttgaatatttttcaaatggcttttttacatatatattgggatggtcatattatttttctttttttcttttcttttttttttttttgagatggagtctcgctcagtcatccaggctggattgcagtgatctcagctcacggcagcgtctgtctcccgggttcaagcagttctcctgccttagccacccaagtagctaagattacaagcctgtgccaccacacctagctgatttttttatttttagtagagacggggtttcaccaggttgtccagtctggtctcgaactcccgacctcagatgatccacccacttccagcctcccaaagtgctgggattacgagccaccatgcctggctgtgattgtataatcttatttgtatacattatggaatttagttaggtgacactttacttaggcttttttttttttctggattcataagtgaaaatggcctataattttgttttcttttagagatgaggtcttgctcattcccccaggctggagcgcagtggcaccatcatgtctcactgtagccttgaccttctgggctcaagtaatccttttgctttagccttctgagtagctgggactacaggcatatgccaccatgcccagctaatttttttattttggagagatgaggtcttgccatgttgcccaggctggtctggaattcctggcctcaagcgatcctctgaccttggcctcccaaagtgctgggattacaggcatgaaccactgtgctgagctaaaaatggcctataattttcatctttctttttgagtttttatataaagtctagtcccaaaataaattggagagtatctttttaaaaaaaattttctaaatgttcgcttaagattgttgtattgcttcctttatgtttgatgagtttgtcaatgaagccaggtagacccatataatgggctataatgcaagtctcaacaaatttcaaaagattgaaatcatagaaaatatgttttctggccaggcatggtggctcatgcctgtaatcccagcattttgggaggcagaggtgagtggatagcttgagctcacaagttcaagaccagcttgaggtcaaggctacagtgagccatgattgcactactgcattccaacgtgggtggcagaatgagactctgtctcaaaaaaattaaataactaaataaaaatgaaaaagaaagtatgttttctgacgacgtgattattatagaaatcaattttaaaaaccttttaaaaaatctcatgtttaaaaattaaagaaatttgcttctagattcttaaggtgaaagaagaaaccataatggaaattagaaactatagtccaccattcttatccttgggttcttaatccatagattcagccaacctcagatcaacagtatttgggaaaataatggatggttgcatttgtactgaacacatacagacttttctcttgtcattatttcctaaacaatacaatataaccactattacatagcatttacattgtattaggtgttacaagtaacctatagatgatttaaagtatatgggaggatgtgtgtaggttgtatacagtgttacaccattatatataaaggacttgggcatccatggatttgggtatccacaggtgtcctggaactaatttcccacagacactgaaggatgactgtattttgaactggatgattacaaaaatattccatatgaaaatatgtgtgtttttacaaaagtagttttagagaaaacatacatattagaaaagaaaggttgacaaaaatgagcaaagtatccatctcaagaagttggcaaaagaacataaaaagcagaagaaataatgaagataaagcaaaaataaatgaaatataaaacaaacataaaataggatcataaaagccaaaagttggttctttaaaagattaataacattgataaacctctgagatgctgatcaagaaaagaacgaatacacaaataactaatattagaaatgaaagaagggatttttactataaatcctatagacttacaaaatatgaggctataatgcacaattttatgctatttttttttttttttgagatggagttgcccaggctggagtgcagtggtgcgatctctgctcactgcaacctctgcctcccaggttcaagcaatcctcctgcctcagcctccttagtagctgggattacagacacgtgccaccacacccagctaattttgtatttttagtttcaccatgttggccaggctggtctcaaacttctgacctcaggtgatccacccacctcggcctcccaaagtgctgggattacaggtgttagccaccgtgcctatgctaattttttaaaactctcattttgttcaggcatggatctcttaggaaatggcaaagtctaaatcgtagactaatcattgtttggcaatggttggtttagtggtggcacgtgatgtgatgttaggaagaattctatggtaaattttgagacttcaaataaaatggttaacttcaatgctgtgttttttgtggggagggttttaaattacttttgcttaactatgaggctattcaagttatctatttttgtgttagtgcttctgatatccttctgacttcatggcataaaaagttaaagcaggctgggtgcagtggctcatgctataatctcagcactttgggaagctgaggtgggaggatcacttgagcccaggagttcaagatcagcctgggcaacatggtgagacttcatctctacaaaaagttttaaaaattagccaggtcatggtggcacacacctgtagtgccagctacttgggagactgaggtgggagggttgcttgaccccaggtctgcagtgagcctgggtgacagagtgagaccctgtctcaaaaaaagaaaagaaaggaaagcaatacttttttaaatttctttcaacaaatatttataggacacctactgtatgctaggtactattatttaccatatttcttatatccagtcagactggattattatttaggacagaaaatttagaaacaaaaacggctcatccctagaaggatgcagctgcttaaaaaaaaaaagaaagaaaaaaaaagaaaaaaaggtggggtgcttagcatagctggtggtgacagtgctattgtgaaagctgagtagcacctatttcacagagcacctctataatttgtaaaggagtatggtttttcagatgttacctttattactgggattcatgacctgcgtagacttcaagtaggtttattgacttcagggtatccacagttcctctgaaattgtatagaatagtttatgtgtatatgctttttggtgatagggaagagagggttcaatggctttccatagatttttcaaagggtccaaaaatgcttaagaaccactgctctgtgggttaagaaaagtttacagagaccaacaaatagtttttttcttcattttgtgttttatgtctgttttgagtaaccattatagtaaaatattatatataagattctctttgacttttgttcaatttatattattttgccattactttaactgataacttttttttaaaggttcaggaacaagtgcatcccactctctcagctaatgaagagtctctctattatattgaagagctgatttttcagctgcttaataaattatgcatggcccagccaaggactgttcaagatgtagaggtaaaaattattttgtcatttcaaaaagtcactcaaccactgtatgaattaatttttgtatctatatcattctaatttattgtgaaaactaaaaccactgaaattatgtatgatatatatggtcagtttgtttttgacaaaaatgtcaaggcagttcattgaggaaaggcaagtttttcagaaaaaaaaaaacttagaacaactgggtacatttatgaggggaaaaaaccttgaaacctatctcatgccgtagacaaaaattaattcaaaatggatcatggccttagacataacagctaaactacaaggtttctagaagaaaattctggaaaatatcttcataacctgggtttaggcacatattttttagagaggactcaaaacatagtactttatattgaataataaggccaggtgcggtggctcacacctgtaatcccagtactttggctgaggcgggagaccgtctcaaaaaaaaaaaacaaaaaaaaaatgttctctatgtcagttgagatgatggttacacagacataagcatttctaaaactcaacaaattgtacattttaagatctgtgtattttactgcatataaatattacctcaataaaagattagtgtaaattttgaggacatttgctcagtgatttaaaaaaatgtatatgtatgtgtgtgtgtatatatatatatatatctgaaaaactgtttaaattagtactaaaataattgttttgccttggttacatgggagtatttttggatttttagcaatatctgttagggagagttttacttcttttgtataaaagcaccctgtgcacataaaattaatattaataaaattggtattattttctcctgctaaaaacaaatgtctaatagtacagctatcaaaaattattttcatttttattttttgagatggagtctcactctgtcgcccgggctggggtacagtggtgtgatcttggctcactgcaacctcagctacccaggttcaagctattctcctgcctcagcctcccaagcagctgggactacaggcgtgcaccccaggctaatttttatattttcaaaaattacttttatactatactgtttacatttcctttttttttgaaatttgtttctataagcaacaactttctttctttctttttgtgaagtggcatgatcatagctcactgtagccttgaactcctgggcccaagttgtcctccagcctcagcctcccgagtagctgggactacaggcacgtgtcactgcgcccagctaatttttatttttatttttgtaaagactgggccttgccgtgttgcccaggctggtcttgaactcctggccttcagtgatcctccctcctcagccttccaaagtgctgggatacaggtgttagccaccatgcccagctacaacaactttcagtataaaggaaaatcttaatttgtagtgattgagctattaagattttccaggattcttggaattaaagcatttttttcccctgttctctgctgccaattgtttgggttttgttgtgttttgttttaagagacagggtcttgctttatcacccagactagggtgtagtgacaggatcatagctcactgtagccttgaactcctgggatcaagcagttctcctgcctcagccttccaagtagctgggactacaagtgcatgcaaccatgcctggctaatttttaaatttttttgtagagacagggtctccctacattgcgcatgctggtttcatactcctggcctcaagggatcctcccacctcagtctcccaaagtgctgagacttagaggcatgggccaccatgcccagcctctgctactagttttgaacatgaaataaacagactgaaagcatatttttcaatagctaaatttgctaaaatctgagactataactataaatataggaaaccctgctaaattagagtttaattcagatctcagtagttcttgtttttcatgccaatgaatcactgattaaattaaaattagatgaactgcctaggtgcagtggctcacacttgtaatcccagcactttgggaagttgaggtggacacaatcacttgagcccaggaatttgagactagcctgggcaacatggcaaaactctgtctctacaaaaaatagaaaaattagccaagagtaggggtatgtgcttgtagtcccagctactcgggatgctgaggtgggaggatcattggagtctgggaagtggaggttgcagtgagctgagatcccgccactgcacttgcacttcagccagaagtgacacagacagagtgacaagagtgagaccctgtctccaaaaacaaaaaagcaagatgaacacaaaggctaagattgtttttgtcaaggtacgtattttcataagccattctgagctctctcacccatttcatcttccaagagatacatgacctcttttatttgaagctctaagattaacgaaaggagagtggctgtatactaatgattaaaaatgaatgaacaatttctgctctgctaggtaaatagttttaactctagaaacctaacttaaaatcactaatacactatttcatgttcgctttaatctttcttatatatcctatgtattgttttttcctttttccggttcatcttaattatgtttaaagctttctttttgaagtttacctttttgttttatccatgaaaattatgtggaaaaattttgatagtcctgttgacctttttttttttttttttttctgttgggggtctccctctcacccaggctggagtgcagtggcatgatctcggcttgctgcaacctccgcctcctgggttcaagcaatcctcccacctcagcttctgaagtagctgggactataggcatgcaccaccaccatgccgggctaatttttgtatttttaatagagatggggtttcaccgtgttgcctggctggtctaaactcctgagctcaagtgatccacctgcctcagcctcccaaagtgttgggattacagacgtgagccaccgcgcccagcctgaccttttttttaagccaaaaaatttatttattacaggaatcagaatgtattgtgtcactattatctgctagcattaagaatagagatcaagttgaattttgtatgaatttcctatttatgaacacttttattaatactacaatggttctgctgtgattgagcaggagcgagttcagaagacctttcctcacccaattgataaatgggccattgctgatgcacaatctgctatagaaaaacgaaaacgaagaaatcctcttttactgcctgtggacaaaatccatccttcgttgaaggtaacaaaagattaaacattagttggggggtgttctttataacaagtaatattttatttctatatttataaagcattaatgtagcatggtctgtgttagtgtgtatatgtgcacttccatatgtatgcttgtacatacacatcgcatatattaatatgtatacaaaatgattatgctctggtgaaattggattgcttttcaaacaatattaaaaattattaatagtgataatgcattactattattttgtggcatcttttttttttttaagtagagacagggtcttgctgtgttgcccaggctggtctcaaactcctgggctcaagtgatccacctacttggcctcccaaagtgctaggataagagtcatgagccatcaggcctggcccattgtggcatctttatggcatcttccaatgactgctactctgactaattcctatgtagtaggccatgattctcagtcatttgttgattaagaaagtgtataatttcagaagctactgtgagttcagaactgtctttaaaattaatttatattatcacagattattttttatatactggaaaagtggactaggacctagtttggctattgcatattaacgcatagggcaaaatatgtttggtgtatatggattttaagagttttgtagcaaattcaagccccccccgccccgcctgcctcacacacacagacacttccatacctcccctcagtagaaactactgtaattaggggatactggttttaaagcagagtccttgaagatagcagatattttgatatttgtcagatgaattttggttaatgtattaagaggcttttagtggagtccaacccaagatttctatatcaagatcaactgttgttgtttgataaaaggcagagttgttagattagatgtctcttaaaagaaaaaaaatcccctaatacagggaccaaagattcattttatatcccgtggtacccatacatttagacatgtagttaatagaaaattttttataagcaaggatgttaaataggaattttttaagtgtgtaatacttgacagtgctacattttgcaattaaattatttattcttttcacaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggtaagtgttacaaggtatttaaatttaacttgaatagcaactatactaatttctgcctcaatctttttgtgtacattattagataagtaatctttataattgctagtactggaagagagaaaaatcctggctttacagagtaaccgtgatatttccaggtttttaagcatatggcaggatggggatctctttttttggtcaagaatcttttacttacaagaaaaaaaacatccaaggcctcaaaacaatttaagtagtttcagttttatatttttagaaagagaatatatagagttctactcaggtacttttaagtgtaagtaattttgaagaccctactttggtttcacagcatagcttagtgaggcacaggggagagaaaattagactgcaatgttgaagttactcccctctgatcatttttttgtttttatatctgtcttctttcctggctgtaagctacttgtgggaagaaattgagtcttccatattcttctatattcctttacttaccttcttattcttcttcctgttatttgagacaaggtctcactttgtcacccaggctggagtgcagtggcacaatctcagctcactgcaaactttgcctccctggctcaagcgatcctcctatctcagcctctcgagtagctaggaccacaggcgtgcatcaccacgtccagctgtttttatattttttggagagatagggtttcaccatgttgcccaggctggtcttgaactcctgagctcaagtgcttgcctcagcctcccaaagtgttgggattataggcatgagccactgcacccactgaagctataacgctgaataacatagcaatctttgtgttagaaggtatttattttactgcaaaataaaaatattataaacagataattacagaacaatatgattaaaactatcatactagtaagtccaaggtacagtggagaaagtaatgaactttagcacgggtgaggccagaaagactacagagaaaatgcctaaatgaaactctctcagggtgaacaaccttcaggacctagcacatgctggtggttctcagccttgactgcacatcagaattaatagaaagctttttaaagaatgctgatgcctgcatatcacccccagagatttaattggcctggattggatctccaaacctcagtgttctttgaaagcattccaggtaattctgatgtgcagttataatgactgagaccgattgtacgatgccataatttcagaaatgacttttcacttacatcatggtagcaattccttgttatctctattttgacttacaaaattatggctactttttttttttttttactttgaaaatatcttagacttttagaaaagttggaagtacaacaaaaagtaagcccttgccacttgaaccatatgagagtaagttgccaatatagtatgtcctataaacaagaacattctgctacattaccacagtatgactgacagtcaaaatccaggaaatgaatacatttgatacattataccatctaactttcaaacatcattcaagttttgtcacatatcctaatgatctttttaccaaaatcattcattccagaatcatatattgtttatgtgtcatgtatttttatcgtcttcagtctggaataattcctcattcctcccttaacttcaaaaaaaaaaaaaaaaagatggcaaagcaggccaggtggtggatcacgcccgtaatcccagcactttgggaggctgaggcgggcaggtcacttaaggtcaggagttcaaaccagcctagtcaacatggcaaaaccccgtctctactaaaaatacaaaaaaagtagctgggcatggtggcatatgcctgtaatcctagctgcttgggaggctgaggcacgagaatcatttgaacccaggaggtagagtttgcactgagttgagattgcaccactgcattgcagcctgggtgacaaagcaagactgtttcaaaaaaaaaaaaaaaaaaaggtggtaaagctgactttattcaagagaggccatggcaataggcacagggaccactgcagtgtaatcctgtggttggggagagagatgttagaatcaactctcctcccttaacttctataacctggacgcttttgagagttacaggtcagttactgtgtagaatgtccctcaatttcggttttctctgttgttttctcttggttagaatcaggtaatggtctttagcaggaatatcatagaaattgtgctgtgttcttctcattgcattttctcagatggcacacaggcacatgatttcattgtgtctcattagtggtggtgatgttgacttcgatgacttgattaaggagttatctgccaggcttttcatctgtgaagttactgttttcccttttgtaattaataaatgaatattttgtggagtactttgaaactgtgtatcttattctttatcacactcaaatttaatatggactaatgaattgttattttattcaatgggtcataatctgttacttcattatttagatgttgtaggccaggcaccgtggctcatgcctgtaatcccagcactttgggaggctgagacaggtggatcgcttgagctcaggagttggagaccagcctgggcaacatgtctctacaaataaaaaaaattatccgggcgtgtgcttgtgactatagtcccagctatttgggaggctgaggtgggagaatcactggagctcgggaggttgaggctacatggaatcgagatcacgccactgcacaccagcctaggtgacagagtgagacactgtctcaaacaaaaaaaagttccggttgttccagatttggttattaggagccctagcttggtttttctgttcctgtcattatttgagcactttattttcttttccccttcctatttattaatttatttaattataaattgacaaattatagttgtatatatttatggagtacaaggtaatgttatgattacaaagaaaatgtggaataattaaatcaagctgattaacatttattacctcaaatacttattttttgtggtgagaacatttgaaatttactcttagctagtagaatgatggttacaaggctaggaaaggtagctggagtgggggaaatggggatggttaatgggtacaaaaatattgttagaatgaatgagatctagtatttgatagcacaacagggtgactacagtcaacgataatttgttgtatattttacaacaattaaaagagtttaattggattgtttgtaacacaaaaaaaggataaatgcttgaggtgatggagactccattttattctgatgtgtgcattatatgcctgcatttaccccatacatatatacacctactatgtacccacaaaaatttcttttaaaaattgaaatgacaaaaaaatttactctttttgcaattttgaaatgtaaatacattattatttactatattcaccatactgtgcaataaatcttacaaaaaagacccaattcctcctaattgaggttttgtcccccttcccttcagcctctggtaaccacattctactctgcctctatgagtttgttccagattccacatgtaagtgaaaacacatatgcattttctttgttgtttgttttttgtttttgttttttttcttttttgagacggagtctcactctgtcgcccaggttggagtgcagtggtgtgatctcggctcactgcaacctccgcctcccaggttcaagcaattctcctgcctcagcctcccaggtagctggaactacaagtgcccaccaccatgcctggctgatttttgtgtttttagtagacggggtttcactatgttggccaggctggtctcgaactcctgaccttgtgatctgcctgcctcggccttccaaagtgctgggattacaggcttgagccaccacacccagcttctttgtttttgagagcttgagtctccctctgtcacccaggctcactgcagcttcaaacccctgggctcaggcaatcctcctgcctcagcctcacaagtagctagagctataggtgcctgccaccatgcccagctaatttctaaattcttgtaggaatggggtcttgctatgttgcccaggctggtctggaattcctggcttctagtgattttcttgcctcaacctcccaagatgctgggattacaggtgttggccactgcaccaggccataaactatttttttttaataagtcattcctttatttgaagcatttttccatgtcctaaatcttcaccttttgagagtttaaaaaaatcttcatgtggcaggattttcagatccccttgttatattgcttttagactgatttctaaaactgtgaagacaatagtccagatttggtctgaccaacagagtatattgaaatgcatgtacgtatccttcattctatatgctattctttaataatttcagcattaatattttggcaccacgttactctgtgtacttgttgagtctgcagatttctaaactcccgaggactgttccacatgaagtaccattatgttaggtctttgatttctccaacttgtgcttgttgattttttgttattgttgtaagaatgaacgtgaatttatccctagaaaacttcatactgttattgaggctatgttccagcatatgtagatattttaaaaattgaattctgtcattcagcattttagatactctacccaggtttttgtaaagtgtacaagtctgataaaccttgaattaaaattatttagtaaaaatgttgaaaaggccaggtgcctttgaatctgagaggcggaggttgcagtgagccgagatcacgccactgcactccggcctgggtgacagagcgagactccatattattttatttaatttatttattttttattgttgagacagagtcttgctctgtcacccagtatggagcgcagtggcgtgatcttggctcactgcaacctctgcctcccagtttcaagcaattctcctgcctcagcctctcaagtagctgggataacaggtgcctgccaccatgcctggctaatatttttgtatttttagtggagatgggattttaccatgttggacaggtgggtctcaaactcctgacctcaggtgatctatccacctcagcctcccaaaatgctgggattacaggtgtaagcccccgcgcccagccaatactccatcttaaaaaaaaaaaaaaaaaaaaaaaaaaattgaaagggattatataagaaatgagatttccaacatatgttattagtggcattcttctaggttaaaagttaccacttttcttcattcctgccttttagttagctattatttcacattttatttaattcatgggtcaacaaactttacctataaagggccaggggataaatattttaggctttgtgggccatacgtctttcttgcatctactcttctctgctcttgtagcatgaaagcagccataaatgaatgagcatgggctatgttccagcaaaactttatttacaaaaacaggctgcaggctggatttggcctgtagtttgctggtccttgtttcagacattcctgtcatgatcccctatttgtcacaagagactgtcatatgcttagctaaaatccagatgacttggccgggcgtggtggctcacacctgtaatcctagcactttgggaggccaagacgggcagattgtctgagctcaggagtttgagaccagcctgggcaacatggtgaaaccccatctctactaaaatacaaaaaatcgtccagacgtggtggcgattgcctataatcccagctactcaggaggctgaggcacaagaattgcttgaacctgggaggcggaggttgcagtgagccgagtaccacttaactccagcctgggcaacaaagtgaaactatgtctcaaaaaaaaaaaaaatcccgatgacttgatatgtgggtctagttatgtaaccctaagtaatgagattgtatgatgtggtatgatcttagtatatccaaactgatatctagagatcactagttcaagagctcacagaccatttgtttaataaattatttgaatatatggtttctagggatatctttaatttgccagacagagaacttgagaatcaaccctatttctttacagttaaaaataaaaataacatgtggctatatgaggtattctagcatatcaaagattgctgagaattagatgatcataggaaagaaccatagaatttaacttctagtatataagttactactaatgaaaatagtatttaaaactggaaaaactgaacataaatgcttaagaaggaaattgatgtttaggaaaggtaaaggccaggcacagtggttcacgcttgtaatcccagcacttttggaggttgaggcaggaggatagatggagcccaggagtttgagaccagcctgggtagcatagcaagacatcatctctacaaaaaatttaaaaaaagaaacaaagaaagaaaggtgagataccctggggaatatagcaagacctcatctctactaaaaataaaaaaaatattagctgggtgtggtggtgcatcccagctacttggaaggctgaggtgggaggattgtttgagcctaggacattgaggctatagtgagctattattgtgccattgggcaacagtggacaaaaaaaaccaaaaaaaaggtgagagaataagagggcacaaagctgctctgaggaagcttagttcaccagatctagatatactagcagttgagttctgtattttctttcttttgtttttaacctattgaattatacttttttttttccttctgagacagactctcactctctcaaccaggctggagtataatggcgtgatcttggctcactgcaacctctgcctcctgggttcaatccattctcctgcctcagccttctgagtagctgggattacaggcacttgccaccacgcctggctaatttttgtatttttagtaaagacagggttttgccgtgttggccaggctggtctcgaactcctgacctcaagtgatctgcctgccttggcctcccaaagtgctaggattacaggcatgagctactgcgcctggcctttgtttttgtttttgtttttttttaaagacaaggtcttgctctttcgcccaggctggagtgtagtggcgcaatctctgcccagtgcaacctctgcctcccgtgttcaagcgattctcccacatcagcctcctgagtagctgggattacaggtgcgtgctaccatgcctggctaattttttgtacttttagtagagacagggtttcgccatgttgggcaggctggtcttgaactcctgacctcaggtgatccatccaccttggcctctaaagttctgggattataggcgtgagccacccatgcctggccagaaaaatctgaagctaacaggagtggggtatgaatatattttctctttcatggtagtattactccatctgtttcaagagctagcttgctcgctcctttttttttttttttttttttttttttttttttgtgacaaggactcacctaagccggagtacggtggtgtgaacacggctcactgcagcctcaacctccagagctcaagtgatcctcatgccttagcttcctttgtagctgggaccacaggcttgaaccaccatgcctggctgtgtttaaaatttttttgtagaaactgggtctctctttgttgcccaggctggtcttgaactcctgggctcaagcaatcctcccagtttcagactggtgaccttctagtgaatagggtctctaggtttgttttttaaatttttgaattatttgccatccatttatatttacagatctaaaaattttacataaaaatgtaaatcccagacttttcatgaaaaaagaaaatcagaatgcctaacagaaaacagctggcactgagcagcacacttcctctttaggtgcatgtaccttccggtttaccataatccccactgtttcttatatattataatgttacttgcctgacccctgtagcatttaaattcaggaactttggtattatgtgaccaaaagagttttaagaatggaactctggagtgggtggtagagaaggtaagtcatagaggaggccccactgacagaatggtgtatcagaagccaagaagagaaaaattgtttggagctggggggtttatatgtgttttttcttatttagagataggatctcattctgtcactcaggctagaatgtggtggtacaatattagctcactgcagcttcgaattcctgggctcaagtgattctcccacctcagccttcagagtagttaggaccgcaggtgtctaccagcatacctggttattatttttttttacttttggtagagatagaatcttgctatattgcccaggctggtcttgaatgcctggcctcaagtgatcctcctgcctcggcctcccaaagtgctgagattgtaagcatgagccaccatgcctcgccctgagagttttaagagttttaagaatgagagaatggtcagctgtgtcaaaaactagagaaaacaagtaggaagactaaaacacaccattagatttgacactagatcaatagtgagagcagttttaatatagtaatgggcttgctaagtgaatgggagcaagaagttacagctagcaagtatgacctactctaaaagggtctctggtggggaagagaagagggtggtagctcttctgtgtgtttttatgtcttatgtcttcctttattttgcatgtctgtttgaaatcagagttcatcaccaaattccctgtgtagccttactggtttctttaaatttaaagtggctgggaagtggggatgatggtctccaatgacaagaaggtggattgcatggagtaagcagtggggaagggagggatttgagagtgtcacagaacatgagattaggaaggtgggttggagttaaattatgaatggcctttatcctaaagaagttaggattttatgcagaaggcaatgaaatccagtatcatttttatgtatcatttatttttagtaacatgattttagaactggggttgggaagacctgtggcaggcagatcaaattatgaaacttgtgtatctttttaagagatggtgattgtttagtggagtaatctaaagcctgcggtaagatggagagagctgaccagatttaaaagatgcttataagatatttctgagttagattcaaaaagattaggaaggcagagttcatgtttactttattagcatattttaccaacatgtggtacagtttatggtgatcagtagatgtttttcagaatgaatgaatgaatatctgttattgtgttgtcagaatttcctctcatccctttgaagtttttactttttgtagtttccttttcagggtatacctttatgctgaactctctgggtacgtttcggtcagtcttaaatatataattaactaggtccaatcattttttttaaaaaaaagtattattaattataaaatgtatggtcacagccaggcgcagtggctcacacctgtaatcccagcactttgggaggctgaggcaggtggatcacttgaagtcagaagctcgagaccagcctgaataacatggtgaaaccccgtctctattaaaaatacaaaaaaaaattagccaggcatggtggcgtgcacctgtaatcccagctactcaggaggctgaggcaggagaatcacttgaacttgggaggcggaggttgcagtgagctgagatcatgccactgtactccagcctgggtgagagagcaagactgtgtctcacaaaaaaaaaaaaaataaaaaataaagtatagtcaactttctttttcactttgatttatagctagttcttgcctgttggttgacctaagtccatggtagcatttctgaaagaagaagtggttgctacaacaatttaagcatctgtgagatgtttgggtttagcaaatgaacgtaatagcagtggtcattgtagtaaatgtgcatcagaaatgcatcgcactgatctatcgtgtgcctctaccatagtagcatttcacttttctccttttaaccctactcaaatatgtactgtcatccttataatatggcaaggaactaccatgttgaatacctactatttgctagatgtagtagtatgcattttatatacattaccacattgaattcttcttatcagctacattttactcataaggaatgtgactttcaaaagaataaatgtgttcataatcatagtcgagtagtggctgaactgggatttttggctcgggttattgttccccaaagacaggcttgctttttttttttttttttgctattatgtgtgtgtgtgtgtgtgtattacagtatacatatatacatatacatatgtattagtacatatttcaccattagttcatatctccagaaatatttattttgccatactcgattttatttgaatatttcccaccttcaacaactttttttccttttattctaggttttatcatataaatttacttataatacacacaactcattgtgtaatatttgtgtgtgcgtgtgtgtgtgtgtgtgtgtgtgtgtgtgtgtgtgtgtgtgatggagtctcgctctgtcgcccaggctggagtgcagtggtgtgatcatgactcaactgcagccttgacctcccaggctcaagcaattctcctgcctcagcctcccaaatagctgggattacaagcgcctaccatgacgcctggctaattttttgtatttttggtcgagacagggtttcaccatgttggccaggctggccttgaactcctgacctcaagtgatcctcctgccttggcctcccaaagtgctgggattacaacacccagccctgtttaataacgtatagatttcaagtactttgaggcagtttttataaaagtaaagaaaataaatttatacattattgatttctgtttctcaggttttgatggacatgtttgatcaggatgacataggtttggtttctctctgtgaagatgaacctagttcttctggtgaattaaactactatgatcttgtcagaactgaaatcacagaagaaagacagtatctacgggaattaaatatgatcataaaagtgtttcgagaagcctttctttctgatagaaagctgtttaaaccttctgtaagtacctttttgggtttgaaattctgtgtaccccaaaaaaccagaccagcttaaaatcataaatagtcacttttttttatttttttgagacggagtcttgctctgttgcccaggctggagtgcagtggcgtgatctcagctcgcaccactgcagcctccacctcccgggttcaagcaattcctgcctcagcctcctgagtagctgggattagaggcatgcaccaccacaatcggctaatttttttatatttttagtagagatggggtttcttcatattggccaggctggtctcaaactgccgacctcaagtgatccacctgccttggcctcgcaaagtgctgggattatacgcatgatccactgcacccagcccataaatagtaactttaaatactttatgagtacattaaaaatactttcatgtatttgtgggctttataaacatgtgaattgttatataataggtacagtgacaatgaaaattaggcacaaaattagaaggaggtttatactggggtgaaatcattttccgttatgcagttctgatatttagagtcattcatttggaggtggtgaaaaagatgtatggtctaggaaaggaagacctctgcatttttctgtcttttggtaagtaccttaaggcagtagtttaaagttttagtttgaagctcagaataccatggggttaaaaaaaataaagttttaacggtggaacttttaaaaataaaagtttatgcagaatgccatgtttaacaaacaaaaaagttttttttctttcttttatcacatgatttatttttccatgtctatgtgtttggcccacactttaaaaataattagtcttgaccgggtgcagtggctcacgcctataatcccagcactttgggaggccaaggcaggcagatcacgtggtcaggagatcgagaccatcctggctaacacggtgaaaccccgtctccactaaaaaatacaaaaaagttagccgggcgtagtggtgggcgcctgtagtcccagctactccggaggctgaggcaggagaatggcgtgaacctgggaggcagagcttgcagtgagccgagatcacgccactgcactccagcctgggcgacagagcgagacttcttctcaaaaaaaaaaaaaaaaaaaagtaacaataataataataataataattagtcttggccaggtgcagtggctcatgcctgtaatctcagctgttttgggaacctgagacaggaggattgcttgaggccaagaatttgagaccagcctgggtaacagagcaagacccagtctctacaaaaaaatttaaaatttagctgggcatgatggcacatgcctgtaatcccagctgctggggaggctgaagtgagagatttgcttgagccaggaatttgagactatagtgagccatgatcgtgccactgcactccagcctgggcaaaagagcaagacctcggctcaaaaaaaagatacttagcctttgtcttatttatcttgtacctcctaacttcctccacaaaataactacatcgtgagtaaataagagtgacactcagacacaggtggttgagtatttaaagttaggaacagatttagcttttctcattatattccaaaagaatgagttttaaatgataatcgaaagtgttttagttggcaattactttttttcttttggatatatgtttagtttaacaatgtttataataactcctactgggaatactatcataagtagtcagaactttatgtttttcaaagtactgttctattttatttgacccttataacaatcctgagggatagaatgggcaaatattgtcatctctactttacttgtaaggagattgactttttttttttttttttaaatatagatgggggtcttgctatgttgttcaggttggtcttgaactcctgggcttaagcagtcttccttctcagccccccaaagtgctaagattacaggcttgagccactgtgcctagctggaaattaacatcttaatcaagttagttatagagcttaatcttgaatgtggcttcttttctaccacgttataattggattttgtctctagtggtatgaagaataaaaacctaataaatgctggcagctaatattatctttgtctttttgtgtcccatcagttttcattcctcaggaattaatttttatgggtctcttttcactggattagtgctgatatgacagaaaatgtctattttaatactaaagggtcagatggaagagtgaatcccttttttatctatctctgtatctactataattttttttagcattaagtaaaatataaacttttgagggaaagactatctaaaatcagagcatagtactctgcaaatattaaagaagtgaatgacttaaaaatgatcttaagttactccttttgcccctcatcctatgttttcaaaaagctcgcatttctggaaggcctaatatgtgccaggagcattttacagaaatcatctaatttaaccctaagaccctgatgagctgggtattagcagaccaaatgtgtgataacgggcaaattacttaactgctctatgcctctgtttcctcatttgtaaaatgaggatgatgatagtacctatctaataaggatattaggttattacatttcaagtgcttagaagagtgcctagaatataatgtgcccaatacatgttagttgttattattgtccttttcattcctaagccagggtcattcatctggcatgttgtaaaagggaaaaacagtttttcctctctaatctttttttttttttttttgagacagagtcttgctctgtcatccaggctggagtgtaatggtgcagtcctggctcactgcaacctctacctcccgggttcaagcgattctcctgcctcagcctcccgagtagctaggattagagatgtgcaccaccacgcctggctaatttttgtacttttggtagaaacggggtttcgccatgttggccaggctggtctcgaaatcctgacgttaggtgatccacccaccttgacttcccaaagttctgggattataggcatgagccaccgcgcctgacccctctctaatcttcacactcaacacagaacatttctgtgacaacgtatgtgaggattttttccccatacaccaaagtaattctcctgtgtacaccaactaggtgtcctataatttagctcaattttgacattatttacctctaaatagtgtcagatctcacagattaaggactcagtcccaacacgactgtctcacacttcaggcgccaattgaaagtcccaggttgtgaactgtgctccgaactgatcagttataaattggagttcccatgaccccctccttgggttccattaatttggtcgaacagctcacagaaatcagggaaacacgtttaccagtttattatgaaggactttaaaatgatacagatgaagagatggacagggcaaagtataggggcacagagtttccaagccctctctgggcaagccaccctcctagcacctccacaaggtctgcaaccaggaagctcatcaagagtttttatggagcttgatctctagcctctcacccctgccctttttttttttttttttttttttttggagacagggtctggctctgttgcccaggcttaagtgcagtggcaccatcttggctcaccataacctctgcttcctgggctcaagcagatcctccagcttcagcctcctgagtagctgggactacaggcacataccaccccacccgactaattttgcattttttgtagagatggggttttgccatgtttcccaggctctttccccaattttttagaggtcagtgggtggggctgaaagttgcaaccctctgatcctttttctttttctcatgagtcagtttggtttcaagtaacccttcaatcctctaatcatctggtctttttggtgactggccctatcatgaggttatctaggggccctactgtaagtaacctcattagcataaactcagtatttatcaaaggtactcattatgaataacaaaagacattattatcactcaggatattcttagcgttttaggggctctaagacaggaaccagggacaaagaccaaaaatatgtttcatattataccacatgtggtggagccaggatccaagctcaggtctgtcaggttccaaagcccgtgatgtttccattataagatgccagagtgaataatagttggccataaccgggatggtcagtcatatgatgtgtttgtgttcagagggcttgaacctgtcttatcctagatatatggctatctgccacatatgatgttttagtcagtgataagactataaatacccatatatatgacagtaatcctgtaagattatactatatttttactgtaccttttctctatatagatatgtttagatacacaaatacttaacattgtgttacagttacctacagtattccatacagtaacatgctgtacaggtttgtagcccaggagcaacaggctatacctatatggcctaaatgttgtagtatatcatctagccgtgatatttgcacaatgacaaaatcgcctaacagcgcatttctcagaacatacccgtctttaagcagtgaatggctgtaattcacagacgggagcttggatgaaatctgtaattccttctcagatccaggagatgggccctaaattgtgaaaccagattgtaacaggattaggagttatcttcattctcatcccagctcttaccattaatctataagactatatagcctaagctataagtaaaacctagggctctgtaagaccttgatcaagtcttttagcatctcagccagttttaaaacactcaaatgccagaattctttatgtaaaaagtagcttagaatcatccacagtaggaggttttagatttaaaaaaactatctagaatctatattttgtagtatttttattgtctgttatccaagagatttttaaaattctcttcctgttcatgattgatttttactgtcttggaatatattaatttgagattcaatgaagatatacccttaactcttatattgtttctttttttttttgtacaagcaagtctctttatttccaaagtacgttgacctctccaacccaagttaaaagaatacacagtatgattccatcttttaatatattaacatcaagatgtacatgtttgaaaatggttggaattttatactggaataatgcatactaaactattaatagtttctacctctgagggtcatgggtgtaaggggggcatgaaagtaaacattcatattttactctctctgtcttgtgtttgaatcttttataatgggagtgcattcacatgtaataacttttatttttacaaagaatgagttttcccaagagcaaaatgcaaaaattctgctatagcttgttgacatttaatggaaatatattgctttatataatatatgaattgttcagaagtgataatagctttaatcatgctcccaataaaagatatgctagttaaagaaattctatagtttattccataaatttaaaaacatgtagaaaacgagtaccacccataaattaaatgatgtatttggtgcagggcaggtaagccccaaagttggggcttagctcgggacagttcttggctttgtctaagaaagaagtcaaaggcatgacaatggtaggaacctctgctgaagcggcagcgtacagcagcagcaaaagtactgtttcttgtggagcagggctattccataggcagtctgcctcgagtagcctatattgctctttatatttagtaattttttagcagaattctcaatctcacatttcttaaccttccttctcttttttcaggatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagtaagtttacaaaactacttatattctcattaaagccctaaatgctgtagtaagaaacttagagatgagtcttggcaacatagtgagaccccgtttccataaaaaagtaaaataattatccaggcatggtagtgcccatctgtggtcccagtgactcaggaggctgaggtaggaagcctgggagatcaagcccatgattgtgtcactgcactccatcctgggcgacagagtgagaccctgtctccaaaaaacaaaatttttttgtaagatattctttatgaaaattagaagataccactggccattataaaaagatatttaagatttaactgataacaaactaaaatcacattgcctatatagtgacactttctttatagtgtgtttatggcaatatttatagtgaaagtttatatactagagtagtatataaactagagtagtaacatttaggttttttttttttttttagtggtaagtatattcaagatgaaggaagatacattttattgaccatagctctttaccttctatggattttaaacttaaagttggaaagaagctttatattattttaatgttttccaaagtaaaaatcattttatcttttaaatgactataaaaataatgtagctcattgtaaaaatattcagaaaaatagatatataaattagatgaaagtcactttattttataacacccagagataacttatccttatatatttctgtgcatacatacgaatgtatgtgtgtttgcaaaaataggatcccactattttataacttactgtttttactctgtatatcataaacattgtccatgttaatgtatatacttcaacacaatttttaagtataaataatgtgatgttatatggagacaccataacatattttaactatctattatccataggttgtagagttttttcctttttttttttgttattgtaaacaacactgcaacaaacatatttgcactatgccttgatattctaatcatttttttttttgacatggagtctccctctgtcacccattctagagtgcaatggcacgatctcgtcttactgcaacctctgcctctcaggttcaagccattctcctgcctcagcctcctgagtagctgggattacaggcgcctgccaccacgcccagctaattttttgtatttttagtagagacggtgttcctctctgttggctaggctggcctcgaactcctgacctcatgatccgtccgcctcggcctcccaaagtgctgggattataggcatgagccaccgcgcccagtcatatattctaatcatttttaaggatatattcctggaagtggaattgtagtgctaaagactagatacatttttagaacttggaaacactttgccacgttcacttccagctaagttccagtgtatgtaagcttccttctttcttcaccctttcccttcactaactcggtattaccttattctttttctttttaattctttttttcaaaatttgttttgttttcatatcggttctgcagatatcccattaatttttgccagtctaatgggaaaagaaatctttcttcttctcttctcttttttcttttcatttctttcttttcttttgagacagggtttcactctgttgctcgagctggaatatagtggcacaatcatagctcactgtaacctcgaactcctgggatcaagtgataataatctgtaccatattggtagaaaatatattcttttaaacctaatgctttttctctttttaaaaaaataggagcaagcatttgatccttatgaaacattatcacaggacattctttcaccagagtttcatgaacatttcaataaattgatggccagacctgcagttgctctacactttcaggtaaacttaaattgaaggttttttttttttttttttttaataaagcaaataaatatctcactattttatccttcaaatatttgtaattctggaatcctcgtaatccttcaaatcttgttcattctaaacctgttttggattatcttctgttttctctctggagttctgtctgttcttattgtagaaatcttttatagtacaacatcatgagtactgaatgaccagaagaatttggcacatactagatctggggtataaagatgaatttggctgggtgcagtgactcatgcctagaatcccagcattttgggaggccaagacaggtggatcacttgaggtcaggagtttgagaccagcctggccaacatggtgaaaccctgtctcgactaaaattgcacaagttagctgggcgtggtggtgagctcctgtaatcccagctactcaggaggctaaggcaggagaatcacttgacccggaaggcggaggttgcagtgagccgagatcgcgccactgcactccagcttgggtggaatagtgagactctgtctcaaaaaataaatagaaaaataaataaaaaataaagatgaatctggagtgtgatttcaggattatgttccctataggaggaagatttggagaaatcttaaaaagttgagataacctcaacctcctatgtactcatactgatttttctatgaggcctacaatttaaaggagataaatactgtattgagggagagtatgcaagttagttggttcaggaatacacttagataaaatgaaaataagtggagagatacaaataaaattttatttttactatctcaacactaacaacaaaagttatgttggcataggtaatacttggctaaatatgtaaaacttctacatctaaactgacttttccagccagacgtggtggctcttgcctataatcccagcactttgggaggctaaggtcagaggattgcttggacccaggtgtttgagaccagcctgggcaaaatagggagacctcatctctacaaaatataaaaacttagccgagtgtggtggcgtgcacctgtggcatgccaggagaattgcttgagcctgggaggtcaaggctgcaatgagtcatgatcacgccactgcactccagccttgggtacagagtgagacccagtctcaaaaaaaataaaaataaaaaataaactggcttttaccccttgacgtttgaatatggtaaaaatccttatagtcctgaaacaaacaagcaaacaaatgaacaaacctttcttcactctagtagaataattaactagagtgaagaaagttttttcatttcctctctcattttttctttgcagccaattgtctttatattattttttaccattctttatgaaaacactaccatgtatgttttaatcaggatataaattgcctttgacaagtaacttaattgccaaatccagtggatatttttatttcatacttaatgtctgtagtatttgttactgctcttatctcttggttcctgtatacctgaaggctgggcgtgatgtctcatgcctgtaatcccagcactttgggaggctgaggtgggtggatcggatcacctgaggtcaggagttccagaccagccttgccagcctggcgaaaccctgtctctactaaaaaatgcaaaaattagctgggtgtggtggcatgcacctgtaatcccagctactcgggaggctgaggcaggagaattgcttgaacccgggaggcggaggttgcagtgagccgagatcgtgccactacactccagcctaggtgacagagcaagaccctgtctccaaaaaatatatatatatatatgtgtgtgtatatgtgtgtatatatatatatatatatatatatatatatatatatatatgcacacacacacacacacacacactagcgggcatggtggtgcacacctgtagttctagctactacagaggcagaggcaggaggatcacttggaggcaggaggatcacttgaacccaggaggtgggggttgcagtgagccgagattgcaacactgcactcaagcctgggctacagagtgagactctgtctcaacaaaaaaaagaaaaagaagactgagactgggtgatttataaagaaaagagatttaattggctcagagttccacaggctctacaggaagcacggctggggaggcctcaggaaacttacgatcatggcggaagccaaaagggaagcaggcacgtcttcacatggtcaaagcaagaggaaggagcagggaggtgccacacacttttaaacaactagatctcctgagaactctattacaagaacagcattaaaggaagaaatccacccccatgatccagttacctcccactaggccccacctccaaaattggggattacagttgaacatgagatttggacggggacacaaaatcaaaccatatcagctcctgtgatactacatgttcccaattttcgtcttctctgatttcttcttctaagtctcttaattattatagctattatccaacttctgttatcagcccctgtttttctgttctgtgctctccttgggtgacttcatgtctatatactggtgacttcttatttgtatttccaggccatcactttcttttaagcactgtgtaccgtgtacatatgtgtatgtatctatacactttcatataaccagctgccttgaattgatgcacttggataccctaaacgcacttcaaatatgacatgtttaaaactgaacttaccatcttctccctgccttctgtactataaattcccattgtttattatcttccacttctctattgtcaaaaatttgttatcatggaatacaaattatacttaattctcaaaattacttcaagagaggaatatttttaaagttaactcatatattcatataaagtatgcattaaatacacagtctataagaactttggatactcattaaaagcactcaacacatttcttgtttcagtcctattttattaggaatttttgctgtggaatttgaatgttaaagggcccagttattaataaagctgtcatcctagatattcagtgaaattggaagagttagatgaaatcctttttcgggccaaactcaattgttttaacttaaaaaaaaattcattcagtttaagataaaataatgcttccttaataaaactaaaaacaaaaagcatctttagaagctgtgtagcgtactttatttatttatttatttagagacagggtctcactctgttgcccaggctggagtgcagtggcacagtctcagttcattgcaacctccgcctcccgggttaaagcgattctcctgccttagcctcttgagtgactgagactacaagtgtggaccaccacgcctggctaattttggtatttttttggtagagacagagtttcaccatattggctaggctgttctgttgaccatgaggcaccatacctggactgtgtagcagacttaaaaaaataagatttgaagttagaacttaaggctttgggccaattaatagttttgtttgtttgtttgcggcggaatctcgctctttcacccaggctggagtgcagtggcgcgatcttggctcactgcaacctctgcctcttgggtttaaggagtcctcctgcctcagcctcctaagtagctgggactacaggcgcatgccaccacacctggctaatttttgtatttttagtagagatggggtttccccatgttggccaggctgttctcaaactcttgacttcaggtaatcctcctgactcagcctcccaaagtgctgggattacaggcgtgagccatcacgcccagccccagttaatggttgtgttaccttgagcaattcacttaatctctgagactcagtttgctcatttgtaaaatggtgatcatcataatatatacctcttatagttattaggaaattaaatggtaatgtatatataaagcataagcataatgtttgatgtgtattaaatactcaaatgtagctcctgttattatcagaggactccttacactgtaaatacatgctacaaaaattttagaatgcactttatcaggcattttagtacaaataagcaaaacagttgatcttgtagactaattttgaagtttcatattggttccagttcaagcactgtatataaaatatccagaataattcactatattaattagtttaatactgtcttagtctattcaggctgctctaataaaatatcataaactggatggcttataaacaatagaaatttatttctcacagttcacatttaggaagtcccatatcaagaggctaacagatttggtgtctagtttggtgccctagtgagggtttgctcttctggttcatagatggtgctttcttgttgtgtcctcacatgatggatagcacaaacaagctcccttaggccccttttataagggcactaaccccgttcacaggggctctgccctcatatccaatcacctcctaaaggccccatctcttaatactgttgcattggggattaggtttcaatatatgacttttgagggaacacaaacattcagatcataacaaatgtgaaaatgaattaatctttaggaaaattggtggcactttttgtgtatcctagtaagaagtttggttactggataataagtctgttgaaaagattataatttaacaaaatgtgaaaattatggtaatatttatgaagatttttttaaagcagcatatcagattctttctcacattttatattggtgtggttggtgtttttcttatggggagaaatactagtaagtgaactatatagacatttaaaattaacatgagttaaatccattataaattttagaaaaccatttattctacagtagtttccaaaactggggtatacctatcccaagctatacactaagatttttcaggatatataaaggcacagagagctttaagggaatctgtttctagtcttcggagatcttgtttatgttttttgcattgtcttttccaaagtctcttacttgttaccttttgctgttatgtatttcccattatgcattgatccaagatgtaaaaacctctagggcaccaaacaggaaaaaaaaaaaaaaaaaaaaaagtattactcctattggagagttcactgagtaccaagcaaaagagttcacaaaagaatgttatagggggatgatagtaaaaattcttggtagccaaaatgtcatctatctatgttatgtcatatctatctgtctaagaattaagaagtgatatggttatcacaaagatttatgttaaccttattgtaagtacttcatcatcatttgggataaagaagaggagaagcttgtaaagttctcataccttgatgtaatatgtcagaagcagttgtagtttcctccagaggcttctaatccttgagaccatgacattaataatgtttgtttgaatttaacaataaagtttgacttctgacaaactgagctgatgttgctgtttattttgacagtgaagatcgactttgtcaattaagttgtatgacagacgtttttcataaatgagctaaatctgaaagttattcaattattgtttagtgaaatagttataaatcacatttacagtatacagcattccctgaaatgcatcttttgtaactatttaaatttaaaacattttaaaattgtgcaggagagtacatagcttttcagaattcctttagggtatatggaagccagaacataagctgtagaggattattgtgaaagctattttagccacataaaagaaaattaatgtatatatttctctaataacttaaaggaggaaagggagaaaagaacaacttgatagcacttcagtttcaatatagaatatgcattctgttgtagttttgataagtctgtatctcaaatttttagtagacgtttctgttaggcactgctgttgcatatccttgatgtcagagacatacatactgtgatatctttttgctttgcagtccattgctgatggttttaaagaggcagttcgttatgtccttccacgtcttatgctggtgccagtgtatcactgttggcactactttgagttactaaaggtaaggttttataacagaatctcaaagtacttatctaatagaagagtttactttttaaaattaattttggagacacacagtaccagtcttttaattcttattttatgtaagtatttaataatttttatatgtaacattgctctaaatttctatcttgttatcttataaaggaaataacttttgaagttaatatttttttctgtgcagtgttgtattcttcctctcttagctgggacccaagcaacacattaaaaatatatatataacttaaaaaaaatgactctcttctctattttaattaactagccaaccactagtcctggtcacattggctaagagggtttggaggctagtgattaattggtggcaaaagtagctgtggcttaggatgagtcaggccattatagtcaatgacctgatcttaaatgcagacctagtagcaaggatttttaaaaagcaatcatctaggtaggggaaaattttttttaaattatatggtcaaaccagcatttttaaatgttggccaatattagagggcaactctaagactaatgataggacctctaataagacatgaaccttatttttaaaaattaaggcatccaaatatatgcttatatattattcatatgaagccagcatatcttttgatgagttctttatggatccactagtatccatggagacttacacaatgaagttgctcatctatttgtggataaaagctgactactgccgggcgcggtggttcacgcctgtaatcccagcactttgggaggccgaggcgggtggatcatgaggtcaggagattgagaccatcctggctaacatggtgaaaccccgtctctactaaatgtacaaaaaattagccgggcatgatggcaggcgcctgtagtcccagctacttgggaggctgaggcaggagaatggtgtgaacccgggagacggagcttgcagtgagcagagattgtgccactgcactccagcctgggcgacagagcgagactccgtctcaaaaaaataaaaaaaaaagctggctacctccagcatcaaatgctgtgggtagtagcactccataaaaaagaacttaaaaaagagataagtattcattagaaataatcatatatattccttgcctagatgcctacaaggtatacatagaattattatggcttttattttaatgttactaccatggattagacggaaaaagtcgtaactgtctatctaaaccaacgatgtggtatcctaaaggagaggtacgaaataatcaagcagaaagatactttgcttctaaagagcagttaaaaagttggaagctgggcatggtggccacaagcctatagtcccacctacttgggaggctgagataggaggatcacatgaggtcaggagttcaaggccagcctgagcaacatagcaagaccctgttaaagaaaaaaaaattgagaaagaacattttactgagcaagatatgtgggaattacagttgaaaatgggccataatctgaaagtagacagaagttcttagatgttagctagagtcagtgaaaatcagtagcagtaatagagagaaatgaatggattgtcaccagaaaatctccatctttcacgtgctcactttggtaatcactcctgcctttaaaagatcaagggaaattgtgtaaggaattagaaatgggaaaagaaacactcactgatgagtactcatgcttgtccaaaggcagcagatactctttattactaggtagtagtaattttgggcttcaaagaatgaataaagagagccaggtgcggtggctcatgcctgtaatcccagcactttaggagtccaagggggagggaatgacttgaggctaggagtttgagaccagtctggccaacatggcaaaatcatgtttttagtctctactaaaaatacaaaaattagctaggggtggtggcacatgcctgtaatcccagctactcaggaggctgaggcaggagacagcttggacaacagagcgagactccatctcagaaaaaaaaaaaaaaggaatgaataaagagaaactacccatgtctgatcaatgaaactgtaaccgttagaataaatatggaatatactcagttttaattaatgcacagcaacaacaagaacaaatagaaatgtggaatggaaagacaagccttagaagagattagaaatggcaaaagatttgaatcacttcacaaaacaggatatccaaaatggcagtaaatgtgtattcaaaccattaatagtcaaggaaatgcagttaaaaccacaggataccactacatacacatcagattacagaaatttgaaagtctgaaaatatccataaacagcagcatgaactatttgcattctgttaggaatgtaaactgtataacccactttggaaaactgcttggcattaccttttaaattaaaaaatatgtatactgtctgactaggcaattccacccttgaatatatactctaaagaaacaaaatgcaggcacatgtataccaagagaaatgtacaagaaagtctgtagcaggtgtcagtaatagcaaatcctgtttgccaaccagaaaagggtaaataaattgtggttcattcagataatgaaagaaacttacactagaacaatacacaacatcaatgacgcttacaaataaactttgagagatgataatatttcattggtgtgttataccatattttatttatccattcatctgttgatagaccgttgaatttttttttttttttttttttttttttgagatggaattttgctctgtcgcctggctggagtgcggtggcatgatctcggctcactgccacctctgccccctgggttcaagcagttcttctgcctcagcctcctgagtagctgggactacaggtgcatgtcaccatgcccagctaatttttgtatttttagtatagacagggtttcaccatgttggccaggatggactcaatctcttgacctcatgatctgtccatcttggcctcccgagatgctgggattacaggggtgagccaccgcgcctggctgactgttggatttttttctaccttttggttactataaataatgcttctgtgaatgtgagtgtacaaatatgtctttgagaccttgctttgaattattttatgtatatacccaggagtggaatggatggatcgtatggtaatgttatctttaattttttgagtaactaccacactgtttttcatagtaatggcaccattgtacattcctaccaacagtgcacagggttctgatttctccacatctttaccaaaccgtgttaatttctttttctttttcttttttttttttgagatggagtttcactcttgttgccctggctggagtgcaatggcacgatcttggctcactgcaacctccgcctcccaggttcaagcgattctcctgcctcagcttcccgagtagctgggattacaggcgcctgtcaccacacccagctaattttttgtatttttagtagagacagggtttcactatgttggccaggctggtctcgaattcctgacctcaagcgatccacctgcctcatcctcccaaagtgctgggattataggcgtgagccaccctgcctggcctgtttttttttttttttttaataatagtcatcctaatggatacgaggtggtatctcattgtggttttgattttaattttcctaatgactagtaatgttgagtatcttttatatacttgttaactatttgtatatcatctattttattgtgttgtttttgggacagggtcttgctctgttacccaggctggaatgcagtgatacaatcatggcttactgcagccttgacctcctgggctcaggcgaccctcccacgtagctaggactacggatgtgtgctaccatgcccagctaatttttaaattttttgtagagatagagtctcaccatgttgcctaggctggtcttgaactcctaggctcaagcaatctgcctgcctcagttttccaaagtcctgggattacaggcatgagccaccatacctggctatattttttttctttggatataagaattatgttataaagttacttataaatcaagaagtgattttttttcttttccttcttgcatgaagattgaattatatgttaagataataatctaaaattatgtttaaaaagcagtttgtagaaatttatctaaaatttatcttagaaagtggggtaaggtgcctcatgcttataatctcagcgctttgggaggccaaggtgagaaggtcacttgagcccaggagttcaagaccagcctgggcaacaaagtgagaccttgtctctacaaaaaaaaaaaaaaaatcagattagctggacatagtggtgcatgcctgtggtcccggctactagggaggctgaggcaggaggattgcttgagtccaggaggtcaaggctgcagtgagccatgtttacgtcagtacactccagcctagatgacagagtgaaactctgtcttaaaagtaaattaataaataaacaaaatttatctgagaagaaaaatgaaaacagtagtttgtgatcaaccttatggggcttaaatttgaaaagaacaaaaaagtattatctataaagtgaatatattatagatatatattctatatatctgccatgagttaactatatatatgtaacaatatatattgccatgcaatataaattgttgcatggcaacaataatataacattattccaacaatgtatataacaatatatattgccatgagtaacaataaaccaacaatgtactttgtttgttttttgaggcacggtctcactctgtcacccaggctggagtgcagtggtgcaatcttggctcactgcaacctctgcctcccaggttcaagtgattctcctgcctcagcctcccaagtagctgagattacaggtgaccgccaccacacccagctgatttttctatttttttttagtagagatggggtttcaccatgttggccaggctggtctcaaactcctgacctcaagtgatccacctgccttcggcctcccaaagtgctgggattgcaggtgtgagccactgtgcctggcctgtttgtttgttttttatttttatttttattttttttgagatggagtcccactctgtcgcccaggctggagtgcaatggtgcaggctcggcttactgcaacctccacctcccaggtttaaacgattctcttgcttcagcctcctgagtagctgagattacagatgcgtgctaccatgcctggctaattttttttaatatttttagtagagacggggtttcaccatgttggtcaggctagtctcaaactcctgacctcaaatgatccgcctgccttggcctcccaaactgctgggattacaggcgtgagccactgcaccaggcctaacaatgtactttgaaataattttaggtaactatatatggtatcctctaatttcttgtcatatagttgtttttccatcttgttttatcataaatctgattttggaaaataaaaaataatatttaaacactaaatccaagaataaatctctcttggtagatcaccaaagcagatactttaaaacagtgggttaaaactgttccaggattgtgttttctactactaaagggatgtaataacctttgagtcacactagtccagccttctttcttatgattctcatcccaaagtaggcttaacatgagacagaatttattttggatgagtactgagccaaaacagtatcacgaaacggcattctatagaatgggaaaatatttgtaaattatatatctgataaaagattcttatccagaatacataaagaactcctacaactcaacaacaaaaaacaagctgactaaaaaaatgagcaaaggatttagacatttctctaagaaggtatataggcgaggcacagtggctcatgtctgtaatcccagcactttgggaggctgaggtgaaaggatggcgtgaacccaggagtttgagaccagcctgggcaatatagtgagacctcatctctacaaaaatttttaaaattagctgagcgtggtaatgcatgccagtagtcacagctacttgtgagactgagatgagaggatcacttgagcccaggaattagaggctgtaataaactgagatcacaccacggcactccagcctgggcaagagagcaagaccttatctcagaaaataatctatgtctgtccttttttactaaggacatgttaactctctcattttagaactggtttattcaaaggcaagtaatgttctcttactctcctaactccctggtcattccttggaaatttagtaatggaaagaataaaaattattctctctcaagaggaattaatttagtttaaagcttaacaggaaaacttagtaataacttcaatgaggttcattgaggaagatcaaccagtatttcaatatgaaacaattgagtttataggtaatatttttttaccttttactttgaaaaacagaaaaaagttacagaaatagtggtgagcacccttcacctggactcactttttttttcttttttttttttgagacagagtctcactgtatcgcccaggctggagtgcagtggtgatctcggctcactacaacccccacctcctgggttcaagcaattctcccacatcagcctcccaagtagctgggattacaggtgcacaccaccacgccattctaatttttgtattgtttgatagagactgggtttcatcatgttggccaggctggtctcaaactcctgatttcaggtgatcctcctgcctcagcctcccaaagtgctgggattacaggtgtgagtcattgcgcctggctaccagttgttaacattatgcaacatttgcttgttatcattcctgttttttttagacagagtctcactcttgtcgcccaggctggagtgcagtggcccattcatggcttactgcagccttgacttcccaggctcaatcaatcctcccatctcagcttcccgagtagctagaactacaagagcatgccaccatacccagctaatttttgtttttttattttttgtagagaaggggttttgtcatgttgcccaggcttgctttgtcattctttttgtgtgtgtgtgagtatattcataacataaagagcttgcaatctctattgaaagaaatctctcaactcttaaaaaagaccataaagaggattttactacatatttactttttcagtactgacatatgattcaggtacatatgaaagaaagttaataacagttaactttcttatgtgtttttttttaaagttagtgttttttttaaaaaagcacgtaaagaaatatgatcacgggttttttgtttgttttggggtttttaggttatttctttttagagagggagtctcgctatgttgcccaagctgatctcaaacttctggcctcaagtgatcctcctgccttgaccttccaaagtggagagattacaggcatgagcccgtgtgcccagcctagtcataggttttaatggatttaatttcccaccaaattaccaactccactcttatgaaaatctagagagtttattactaataaaaaagaattgattacatgttttatttcacacctagactgaactcctagtacagtgaattagagacaaattcataatttattgaaattccccttgctgtgggcacatatgtccatagtagatgtagcatttggtaggagtttcaagaaaagcagggtaaatatttcagtgaattctcatacagagttaagaaaaaacttacatgaaatataaaatcttagacaggatacacttatagacaactaaggataatgatgagtatcaggtagcaaggaatatattcttcagctaggttcataagatattacccattaaagctaggcgcggtgggtcatgcttgtaatcctagcactttaggaggccaaggaaggtggattgctggagctcaggaatttgagaccagcctgggcaacatggccaaaccccatctctacaaaaaattcaaaaattagctggatgtggtggcaatgcctgtagtccaagctactcaggggttggggggttaaggcaggaggatcgcttgaacccgggacatcgaggatgcagtgagccgagatcgtgccactgcattccagcctagttgacaaagtgagactttatctcaaagaaaaagaaaagatattacccattaataaacaatcacttttatttttaattttaagcatatgtagcaagggtatcttttctctttgacctcttttccagagtacactcatttcattttatttcttaaactcagtagttatccagtttgttttcaacatagaaagaatccctttcaactcagtggtcatcagatttagacacagaccagtgttttgcgtagctgtgtctggtgtcatggtagagccacggggtattagtgtagcaaaaaagcagagactttggggtcagagctcctgggtttggatataaactctcctatttatattgggcaaattacttaatttctctgtgcctcatttccttcatctgtaacatatgattatagtacctcgtgttacagagttgtaataaaaattaaataagctaatgcataaaagagcgtgcacagagcagagctcaaaaaacattcattattggtctaaatacttaacaaaatcatacagtagtcatttattccagttacttctgacaaccacctagtggatacctaccacatgcaggtaaactgaaaaggaataaaacgtgtccctaggcattaagatgtttacaatttagtgaagaaaatagatgtcaaacaaataattacaatattataagagcctaatagaggtagtactatgagatcaatgaagcaggagttactagctctgcttagggaaggcagaaaaaaattcctattgatttttcctttgttcagtggagtaaaaaaaaatacataatggttttgggtattcgtcctactgagagagagaacagtgtgtgcgcgggtgtgtgtgtccttatttatttgcgggagtcatgaaagacaaatgcttaggaactctccagaataaaagagacaatagaaacatgacaatttagtgcttcactgaccagttcctgttttgggggaaaatattaccttaaaggatgttattaaaacagttggcaaaattggaatatacactatagattagattatgcagtagattactcggtgttaaatttcctgaagttgatcactatactgtgattctgtaaaagaaaatccttgttgtaagatgagctatgagaaatattaaaggagtaaaggagaatgatactatttgagagtaatttgtgatacatttgacttttccttatattccaaaaactactgcaaaaccattcagccgtagtcccccttcctctggaaggaactgagtggatagtatcacaactactaaaaaaacgatctgcacacactggcacacagaatgatgaagcatgtgacaaaatgttaaaaattggtgattcagagtattacaggagttatttgtgttacttttacaacttttctataaatttgatatttcaaaagaaaaaatttaagagggaaaaggcataatcagaaggcatcttcaagaggaagcatttcaactgtatcctagtggctaaattcaccgggtggataaggaggtcagagactgttgtgtagaaagcgaatgggggcatgaaagtacattacttgtttgcacatagttcagtacagtaatttttcttttctttttctttcttttttttttttggagacagaatctcgccttatcacccaggctggagtgcagtggtgctatcttggcttactgcaatctccacctcctaggttcaagtgattctcatgcctcagcctcctgagtagctgggattacaggcatgcaccaccacgtccagctaatttttttttgtattttttatttttattttcatttttttgcgggggacagagtctcactctgtcacccagactggagtgtaatggcacaatctcagctcactgtattctctacctcccatgcttaggtcatcctctcacctcagcctcccaaatagctgggactacatgtgcacatcaccacgcccggctaatttttgtattttttgtagagacaaggtttctccgtgtggtcaggctggtcttgaactcctgggctcaagtgatctgcccgccttggcctcccagtatgttgggattacaagtgtgagccaccttgcctggcccagtaatttctgtgtaagatgtttggaacacattcttttaagtatctgtagaatattagttggatattcattaatatgatgtttatcaaatctcactgctgaaaattcaagaaatatttagcaaattatcagattattatgccaaacagagccgttgtttaatatacttccattaccaggaaatcccactctaaatatcctcaattttgttctcctttacagcttataattattacatggttatttaaaaatgacacgtggaagagtttgagcagccttaagaccaagtagacaatgaaaatcatacctttttggtaggatatcactactggtgataatttagatatttggataaacaaaaacaagaataaaacagttctaattaagtgtttgatgtcatcaacattcatatttattaaagaaatattttagagtggagctgagaagactttctgtaagaaatctttaaagcagcaaaataagtgattttgccagtaactttcacctgtagaagtcagaataaccaagcacagatcttttttcaaactttctatgatattttgactttgcttccatcctttctattgcttagtctagagattaaggtattacttctaataatagtcatttacattatttatgttgctaatctcttgatgacaagacctctacatgtgtcttgaaataaaatcaaatggctctgtgcttcatatagagactaatttctaagacataaataaaaggtaatggacaaagttgtcaaacaatagccagttagttctttgctgaggaaagggaaccattgctgaatgcttttgagattgctcttggaatataaggaaaattttaatttatcacaaaatctctaataagttaaagatcacaaaatagatttaagtttttaaaaattttctgaagtgatcataattccccatatccttgcataaatatatatttataaatacataatatatataatatctatatgatgttccactttgaactcttctttcaaaagattaaaacagtttgagggcagcctgggcagcatagtgagaccccatctctacagaaaaattaaaaaaaaaaattagccaagcatggtggcacacatctgtagttctagctacttgggaggctgagatggaaggatcacttgagtccaggaggttgaggcaaggctgcagtgagccatgatcacctcaccgtattccagtttgggtgacagagtgagaccctgtctcaaaaaaaaaaaaaaaaatcaaaacattggagcacaatacaatacaatctgaattatttattataagtaaatttgctttctttctgagagtgaaatacaagagaacattttggggcaaatgaaatagaaccagagttttagagattaataagtcagtttctaaatcttctaaagattgagatagaattaattttcatggtttcttgacatttcatattgtaaaaaatagcagtggaatcctttgagagatgctgtttacggaaaagtttatgatagattgaagtgttaaaagttagtacccttgattatgttatataacaaagatttgtaaacttgaaattgctaaaacaaagtaatcattagagaatatgaaatagtttatagttacttattttctctattcatagttgctaatgaataaaagtaagttgtaagcttcatgctttaggtgttttaaactttttaaatatgtttggaaaatgtggcctggcacagtggctcacacttgtaatttcaacactttgggaggcagagatgggaggatagcttgagtccaggagtttgggaccagcctagtgagaccctatctctacaaaaaataaaaataaaaaaattagctggatgtggtggcatgcaactgtggtcccagctactcgggaagccttatgcccaggagatcgaggctgcagttagccctgccactgtattccacccttggtgacggagtgagtaagaccctgtctcaaaaaaataaaaaataaaaataaaatgtccgaatggtttttacagttgcttttttttttcctgattactatgctcatgttagtttatatctgtattgtgtttatgtttatagaaagaaggttgggccaggactggtggctcatacctgtaatcccagcactttgggaggcagaggcagaaggatagcttgagcaggtgttcaagaccagcctgggagacatagcgagaccctgtctctacagaaattttaaaaattagctgggtgtggtggcattcgcctgtggtctcagctacttgagaggctgagagtggaggatcattagaacccaggagctcaaggccacagtgagtgagatcctgtttcaaaaaaaaaaaaaaaaaagaaagaaaaagggttggtttgagagggcagtaggtatatataaaattatagctgtttttattaagtatatataaaattaacttagagttgataatatttgttgctgctttttctattactagaaagttgggggaagaatcaaacaatgcagttttgatttttctttctgttttttcttagcaattgaaagcatgtagtgaagaacaagaagacagagaatgtttgaaccaagctattactgctctcatgaatctccaaggtagcatggaccgaatttacaagcagtattcacctagacgtcgacctgggtaattccaaagtgttgaaaacgtgaatgcctctgcttacttcgctgtctctgatgcctggttttcaaagaagtgtgatttattgtgatagttacattattgaaagttgtgcttgtcatacttttatatacttttatgttggtcttttactctcttttttccttttcctttcctttttttttttttgagaaggagtctctcttgcccaggctggagtgcagtggtgtaatctcagctcactgcaacctgcagccttagcctcctgcgttccaatgattctcctgccttcgcctcccaagtaactggaactacaggagcccaccaccatgcccagctaatttttgtatttttagtagagacggggttttaccgcgtcggccagactggtctcaaactcctgacctcagcctcccaaagtgctcggattacaggtgtgagccgctgcgcccagcctttttttcttttttttaagagacagggtctcactctgttgcccaggctggagtgcagtgatgtgatctcagctcacagcagcctcaacctcctgggctcaagcagtcctcctgcctcaaccctctggagtagctgggactcgagtagctgggtggcacatgccaacacacctgcctaatttttgtattttttgttgaaatagggttttgctatgttgcccaggctggtcttgaactcctgggctcaggtgatctgcctgctttggcctcccagagtgttgagattgcaggtctgagccactgcacctggccaacccagcctagtcttaagattagcattgttggctgggcacggtggctcacgcctataatcccagcacttcgggagtccaaggtgggcagatcgcctgaggtcaggagtttgagaccagcctggccaacatggtgaaaccccatctctactaaaaatacaaaaattagccaggcgtggtggcaggcacctgtaatcccagctactcgggaggctgaggcaggagaatcacttaaacctgggagggggaggttgcagtgagccaagatcgtgccattgcattccagcctgggggacaagagctccaaaaaaaaaaaaaaaaaaaaaaaaaaaaaaaaaagattagcattgttatattattaggatagacttaataaatgtttaaaaatataatctatgaaagaaatttaggattttttgtaattttagttcttatagagccagtagtacttctctttcataataatgaaattgagggctgtattatttagtggcaaagttagaactaaatgctgtgcgtaaaagctactgtttggttatttaatattttactcacttgatttgagatggtttatgcttgaaaccatttgggttgctagctgttgaataagctatattgtttgttttttctagagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcaggtatgtgaaactcattacaactgctgacctagggcctgggacccaaaagctttttaaggatgctcaaaaatatttgaggcttggggaaaaaatggattgcctccaaaatataaaaatactgcaaaaacaaaaggaataaataagagaaggaattaaaggtctaaaaatgtaatattgttaacttcattaattattgaataaatattcataaaatatgcatattcatgaattttttttttttgagacagagtcttgctctgttgcccaggctggagtgcagtggcgctatctctgctcactgcaagctccacctcctgggttcacgccattctcctgcctcagcctcccgagtagctgggactataggcgcccgcaacaatgcccggctaattttttttttctttatttttagtagagatggggtttcaccgtgttagccaggatggtttcgatctcctgacctcgtgatccgcccacctcggcctcccaaagtgctgagattataggcgtgagccacctcacccagccatattcatgaatttcaaatttgaaaacaatcctcgcttattaaggatataccatagtatattctctatgtcagtatttctctatgtatggcagggataccatggtatcctgccagtaccatgattgttaggaaaagccacaatctgaggagccaaagtaaaaagaaaaagggaggaaggcctccaaatatggtactttgagttaattaaactgaatacattaaacatgaaacctattttatgctctgccttttcagatcccaattttgttcgtacttttcttaccacatatcgttcattttgtaaaccacaggaattgctgagcttactgattgaacggtaagaaaaatatgtatttcagttatattgacattttgtgaaaaattaactgtattttgtaaagtgcctagtacctaataaatactcaagttaattattgaacatattttatttggcattaaattggcagtattactattctcttcaaatggagtactccctaaaatctgtttataaacacagatcttttcagctcttagaaatatttcaagtggtaatcagaaagactaatttagaggatgaaagcactatattttaatgaatattgttctgtgtaataaaatgatattttcttaaaagagacttttctacttaccactatttttttttttggaccgtagactactttgccaaatactttccacttttaaaacaaacttgttatgaaaactttcaaaacacatacaagagcagatacaagaatataataaacccatttattcatcaaccaccttcagtaattatcaactcattgtttcatctgtttccctacaaatttaaacaccccaccccatgattattttgaagtagatcctagacaacataattcatctataaatatttttctatgtatctctagaaaatacgggatcatttttaataatcagatatcattattaaacctaaaaaatcagcaattcctttattatgattaacttttaaaaattagtgttgggttgaatttgttttacctagtattatagtggcattttaaatgttttatagtttaaaatgtagaatctggactccagaatgatttttagttttacgttttaaaacttactaaaacttattattataccaaagcttattaactgtattatcaagatataattctagatctctatcactatgttgttttatcaaactaaatttaccagactgagtcagtgtaatgtgctatgaggatctacttagttgtttccatgtccagaataaggaaagcacacgttagacttatagtttagctgtatttcctatgtttgagcaaggttttttatctttatcttatccacttaggtaaattatttaaatattgttaaatattcggttttggccctctctttgaatttgtactcatttaaataaatttattagcctactttcattttaataatataaatattaaagacattgttagataagcaatttctgtcatgttctttaaattccttatgaattctttccttggctcttttccctggaccttttctgtattatcagtgctaaaagacaaaactttagtttttataaaagtaagaatacaaaacgtcagttttgtatagccaaaggacagttttttgtagtatatcatacctcaagggaagtttaacagtaatccacttttcgtggaagtggtaggaaagaaggttgcttgctgttttcctccttgtattttcattatgtatgaacggatttttctccttttgcttttcttcttaggtttgaaattccagagccagaacctactgacgcagacaaattggcaatagagaaaggcgagcagccaatcagtgcagaccttaaaagatttcgcaaggaatatgtccaaccagtacaacttaggtttggcttgaatattttttatatatatatatatacacatatatatacacacacacacacattttatgtgtcagttttcaatatatagttaacacaaaagctctcagcttttaattcaaatatagggaatatttttaacttcacagcagttaagttaaactaaaagagttctttctcagtgaagctattcttaaataccctgaagaaattcaaatatttaaatatcctatgtttgcatcacatatctctggcatgtgatatgttatgcttacgtatcaggatacctattttttattgtaagtaaaaattataaaatttcatgtgagctttcctgctgtcaaccttttttcacacttttttccttcatttccctttgcgatcatacagtaatcctggctttttttacaatttataatatttgtggaagttctagcccttttcccacttatctctcacaaaatatatagacatttgttagtttaattgcaataatttctaaaaatgtgtttgattgtagaagcttccagttaataaatactactgtgtgccggggattaccctaaatgctttatcttttttatctcattcttacaacatgattactattcctactttatatataaggaaattgaaacctagcaaggtgaagtaatttgagctaagttatgtaaagggagtggcaggacaagattcagactcatgtctgactttctttgcgtgtgtgtgtgtgtgtgtgtgtgtacgtaccactaagcattgaaaattggaagcgccttctcttagccctctttactgtccaagtaaccaaagtattatcttcctccttccattggaaaccaagttatcttattaattatatgtaatttaaattttttttctctctaaatttcaagtttccttgattactgttgaccaataaattgtaattttggaactgagtatattagttatttatttcccaggataattgccacaaacaaatgcagttttagaagaatgatagtgctcccagctatatgtctttcactaaaacttttaacgtcattctttgtataagaagatgagattatttatgtatcagcaataaataagtaattcttttctactagctgtgatgcatttgtacttatctacaatcacattaaatcccttgatatgacacatacatttatgaggttgctattgggtggggtagggggtgggagtataatcttcgtttctcagtcatataagctctttatgtatttctaagcatttgctgtgttctcagtcctgtacttataactatgctaagtacaaaaataacatagactgtcatgatattgtggctttcttggggactttactgggggaaaaagacacatgaaacagttatatattgttctacttggagtgcttaagtgacttagaaaaatacatccctatacaatttcaggaatagcaaagattaggccagagtaattagggaaggcatcttggagaaggtaaaatctgagactgcccctaaaggatgtataggctttagataggtagaaaggtgactgtaggtattcagggtcatgagaaatagtatgaacaaagacaagaaggcagaaatgagaatggtgtgctgaggacacagataaggacattgacctgagaggaatgtaggcattgtattgcaagtagtagatgagattacctgtatggaattggatggagtggaaaactgtgaaatccaagccaagttattaaacctgtttatataaatattgaaagatttctagtaaaatgggtggtagtaatttttctaacattttattatgaaaaattttaacatacagcaaaactgagaattttacaatgaacacccataaacccaccacctagatatgtattcatctattcatatctattcatttatgtgttcatttatcattcatctatcagttcatttttttgtatgaattttgaagtacactccttaaatacttcaacttgtatgtcattaacagttcagtgtttgtttttcttttgttctaaaatgtgcatataattaaatacatttttttcttgctgccactgaagacagaagatacacacatcttaagtgtacttttgttgagttttaacaaatacatgtatctccataatccaaacgcctttcaagatatcaaatgttactacaccccagaaagttcccttatgttccttctcatcagtttttgttcccactgcccaaaggcagtgttccaatttctccctccatagattagttttacctgttttagagtcttaataaatgcattcttaaaaactcaattttgtgtcttctttcactcaacatgcttttgaatttgtatcaatggcttattttattgcgaggttgtgttttattatatgaatataccagtttattcatttttcccattgaaagatacatgggctttttctcgttttttattattatgaataaagccgctatgaactttatcttacctgtcttactgtgaatatttttcacttttcttgggtaaacaactcagagtggagtggctgggtcagaaggtatgtgtatgtttagttttgaaagaaactgccaaaacttccaaaacattctcaccaacaatgttcaagttgcttcatattctcaccagtgtttagtaatgtcagtctttgtgccttagccatactgctggatgtagtggtatttcattcatacttattttgtggagaatctgttcaaatcctctaatttttgttgagatacttgtctctttattactgagttgtaggagtaaattgggtaggactgaatgccagtcctttgtcagataaacattttgcaaatattttctttccatggcttgcctactagtttccttccttccctttccttttcccttcttcctcttccatttccctcctcttccctctccccttgtctttcctttcctttccatttgcatagttgattaaatctctctttgcaaggttataggtaatcatttttgtgatactgtaaaacaaaacagttctatttttgtcttttgaaatgaaataagagactgtagtatatgtgtagattacatagaaatttgatgataggctgggtgcagtggctcacgcctataatcccagcactttgggaggctgaggtgggcggatcacctgagatcaggagttcgagaccagcctggccaacatggtaaaacgtcgtctctactaaaagtacaaaaattagcccagcatggtggcgggcgtctataatcccagctacttgggaggctgaagtaggagagtcacttgaacctgggagttggaggttgtagtgagctgagatcgcaccattgcactccagcctgggcaacaagagcaaaattccatctcaaaaaaaagaaagaaatttgatgatagcacttgcatttagaaccagatacagtacatcttagttggttttccattttaagtgaaaaagtaccaaaatttaaatcttaaaaatgctttttatgaacttaaaatagcttttgtaatatagagcataagttttctacatatgaataaagggtacttttccttaacataaatgggaagcacagaaaccactatttttatgcttataaatattttaaaagtatacattttattaataaataatacaccgtttggagacctactctcctcttgtcattgaagcatttaaagtattaattaaatacagattagagagtctttgagtattatgttgacccttgtatgtaaagctattatcgtggcattagagaaggaagaagtgtaattgaacacttatgtttcactaaaatgtgtttctttccattttatcaggatcttaaatgtatttcggcattgggttgaacatcatttttatgactttgaaagagacttggaattgcttgaaagactagaatccttcatttcaagtgtaagaggtatattatataaaggtttgattgaatcttatattgaacatgagtttatgttcaaatttgtgtgactttaagaaactaaaacatttctctctcttttttttttttgaaacagagctttgctttgttgtccaggctggagtgcagtggtgccatctcagctcactgcaacctccgcctcccaggttcaagtgattcttctgcctcagcctcccaagtagctgggactacaggcacatgacatcacgcctggctaatttttgtatttttagtagagatggtatttcaccacattcaccacaagaccagcctggtgtcttgaactcctgacctcagatgatccacctgcctcagcttcccaaagtgctgggattacaggcatgagccaccatgcctggccagcatttttcatttttaaaaagctgaaataacatttggaatgttttttatagacagcaagaaactcacatatgtttagaccaatcatctgaggtctcagaactttgccttttcaagtttttgaggagaatatttcttttaaagaagtcgaaagttctttttaataaatttaagctatttaattttatctcattgcaaggttgccatttcttcaactgaataaaaatatgtgtaattttatgttttctttctttaatcttattcttttaatgattaacagctttcttataatatttacatcttctggaaatgtttttggtatatttctgaaatctgaaagagaggagttttctattttaagtttcagaatcatagcccaagaaatgaaaccctaggccatgaacatttaaacaaatgtgtcatcaaatgtatattattgaatcaagaacatttatgttttatctgacattatagggcattacaaatactataacaagtgtaacttatttcgtgttctacttgttctttaaggggaatattatttaaagttaagaatgttattcctttgtttctactttgagatgtttatgatacatttttatgtgtgccttgaaattgtcataatactacattttcaagttgtattctaggccagtgcaatggctcacacctagaatatcccagcactttgggaggcagaggcgggctgattgcttgagcccagaagtttgagaccagtctgggcaaaatggcaaaacccagtctctacaaaaaatatgaaaattagccaagcatggtggcatgtgcctgtagtcccagctactcgggaggctgaggtgaagcgatcacttttaagcccagagctcgaggctgcagtgacccgaaattgcaacactgcacacaagcctgggcagagtgagaccctgtctcaaaataaacaaaaaacaaaaatttatattctaaatgagaatactggattagacacaatctaagaagcttctaaaatacacacacacattagaataaattaagtaaatggttatgttaatgtccaaagttcttttctatactagttatacttcagaataaccaaatagttcatgaggaaaagtttatttttgtggaagtatttcagctagtaagtgaagaaggaatggtagaatatcacatttctcaggtcctagtaaaataataaacctagggaattatcatgactggatgggtactatcacaaaaagttaactagacattatatgcctcctgttagaagtattcttggcaagtatttgtgtcataaaattaatcctgaatcagaccaagtcactatatctctgctttacagaaaatatagaggacagaaaaacatggcaaatgacaatttcttccacaaagtgcaagcaaaaatatgcaataaagcagtaacctgtagattaaaggagacttgagacacattgactcagtgcaatatgtgcaatcttgttcagatcccttttcaaactaaatataagaaaatatggccaggcacagtggctcatgcctgtaatcccaacactttgggaggccaaggcaggcagatcacttgagcccaggagttcaagaccagcttgggcaacatggataaaccctatttctactaaaaatacaaaaattaggccaggcgcggtggctcacgcctgtaatcccagcactttgagaggccaaggcaggcagatcacgaggtcaggagttcgagaccagcctggccaacatggtgaaaccctgtctgtactaaaaatacaacaaaattagccaagcatggtagtgtgcacctataatcctagctactcaggaggctgaggcaggagaatcgcttgaacccgggaggtggaggttgcagtgagccgagatcacgccattattctccagcctgggtgacaaagtgggactccatttcaaaaaaaatacaaaaattagccaggcgtggtgatatgtgcagtcccagctacttgggaggctgaggtgggaggatcacttgagcccgcaacatggaagttgcaataagttgagattgcgccactgcactccaacctgggccacagagcaagaccctgtctcaaaaaaaaaaaaaaaggaaaataatcagagagagaaatgtgaacagtgacaaaatacttcaagataacaatgtattaagaagttgtcagttttatgtgtgataatggtgttgtggttattactttaaagagtgttttaaaggtgcttaaatatgaatgaaatacgatgtctcggatttgtttcagaataacctaggaagtgacgggatggcatgagtagggttagagaaaataaaaattggccatgagttggtaactgttgaggctgggtgaaagttaaggattaaatgaagatttgcagtcatgtctgtcaagtaaaagacatttttctttatgtgttctttttccagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggtagacaattaatgttaatgtcttgctttatttttaagaatcttgaacattacctattttcaaaacattttgcacattattcatgagtgcttaaaaatacctcatctactctcatgggcttagaggaaaggtcatagcacagtttttaactagtctgccctgcaagtaaaagtcttatgtctagactggggactagcaatccattacaagaggaatggcaggaagattttcaagtccaccacccctcttcaactcctaataccttctcaccttggtttagtttgaggtcagtcagtcaagtcagttagtatggatgctaggcccttagcagctaagtgaatagaatattgtgtgagatgggttttcttttctcatttacagctcaggctgttgcgaagggtacaggccttgcatgtaacagctctctgtcgaaaaatgtcactatcattatcattccatcaaaaactttttctacaccaacctctctgttttcccctcctcccaatccttcccagccactaatacctgcagttctactctctacttccatgagttcattttttttttagttttcatatatgagtgggaacatgttatatttttctttctgtgtctgatttattttgcttaacataaggtcctccgggctcatccatgttgccttgaacgacaggctttcattctttttttatggccgaatagtgttccactgtgtatatataccacattttctttattcattaatctgttgattccatatcatagctattgtgagtagtatagaagcctcaatttaaaatataaatgtgcttggctgggtatgatggctcatgcctgtaatcccagcacttaggaggccaaggtgggcagatcgcttgagaccaggagttcaagaccagcctgagcaacatggcaaactccgtcatacaaaaactacaaaaaatagccaggcatggtggctcgtgcctgtagtgcccctgtagtcccagttgcccaggaggctgaggtgggaaggtcacttaaggtcgaggctgcagtgagccaagattgtgccactgcactccagcttgagtgacagagtgagaccctatctctaaaataaaaatattttcatggagttatcctgattagcagccaatttttaaataaagattacacagggaaaagcaagaatatataaaatttagtgctaataggtaatatagtaaggtacctttactacattatgtttactttatgttctttagaatttgcctagtttgcactggccatgccattcagaaccagacttttagcgcacccaccagaagttgtcaacatctgactcaaaatgttatgttatattttaagtaatttagaatccaggtagctttgtttatgttgtgggatttgtgatacgtagaaatgaagggacttgttacttgaggtaaaaaaagcaaatagtactgcatcatgttttttctcacaatgtaattgttttacatgaatggacatcagaaaaaaagcacttcacttcatgtggacctactttcaggacatagaaaaatacctaatactgacttcatttgtaaactaaatttttttttttttttttttttgagatggtgtcttgctctgtcacccaggctggagtgcagttgtgcaatctcggctcactgcaacctgtgcctcccaagttcaagtgattctcatgcctcaacctcccgagtagctgggattacaggtgtgtgccaccatgcccggcttttttatatttttagtagagatggggtttcaccatgttggccacagtggtcacgaactccttacctccagtgatccacccacctcagcctcccaaagtgctgggattacaggcatgagccactgcacccagctttgtaaactaaatttctggtgaaataatagagccactttaagaaaacatttcagaaactgttagcaagtacttatttatacacaaatctactgattaaaaaatatttttttaatgaataaccaagtctgtaggccattgatggcaatgccaccagtcaattaaaaagaaaaaaaagagatagggtctcactgtgttgcccaggctggccttgaactcctggcctcaggcagtcctcctgccttggcctcccaggtgctgggattacaggtgtgagccactgtacttggccaatttttaaattgtgtattctgactcactgtatacaatgttttaatctgctcttctgtctgaattttaattaaatactcaggcattcaaaaaatataggaaataatataatgaatattcatgaacaacaaaaacattttagataaaattgaaatcctttgtgtaattctcccaaatcttattgctctctttcccctaagaaagcactaccaccctgaatttgatgtttactatttctctttatatttttaaaatttataaacatacacggagattcataaacaacgtatagcattgttgtacactttttttttttttttttttttttagaaacagggtctcactctgttgcccaggctggagtgcagtggcacaatcatagctcactgtagccttgaactcctgggctcaagcaatcctcctgcctcagcctctcgagtagctagaactacaggcacgcaccaccatacctggctaatttttttaaaaaaatttcatagagatgaggtcttgctatgttgcccaggatggtcttgatcttggcctcaagttgtcctcccacctcaacctcccaaaacgccaggattacaggtgtgagctacagtgcccaactggttttttgttgttgttgttgtttgtttgtttaagatggggtctcactctgtcacccaggctgggatgcagtggcatgatcatagctcattgcagccccagactctaggctcaagcagtcttcccacctcagtctctcagtagcaggaactgcagggaggaactactgtgcctgtttttttttttgttttatttttttgagataggatctcattatgattgcccaggatagtctcaaaccctttgcctcaatcaatccttccacttcatcctcccaagtagctgggattataggtgcgcaccactgcacctcagcttgttttgcactttttttaaactgcatatacttatgtatcattctgcaacatgctttttacttaaatcatttttggcatttgttcaagtcaatgaatacagttctagttagcttattttagatgctgtgtagtgttccgttatatttatactccacaatttatccagtctctggatgatgagcctctattcactcttgcaaataatgcttcactgaatattcttgtaaacgttttcttataactttgttttttgtttgtttgttttgagacagagtctcactctgttgcccaggctggagtgcagtggcatgatctcagctcactgcaaccctctgcttcctgggttcaagcgattctcctgcctcagcctcccaagtagctgggactacaggcacgcactactacgcccggctaatttctttgtatttttagtagagatggggtttcgccttgttggccaggctgttcttaaactcctgacctcaagtgatctgcccgcctcagcctcccaaagtgctgggattacaggcatgagctgctgcacctggctcttataaatttgtgtaagagtttatctagggtatatgcatacttaagagtcaaattgctgagtcatccgatatgtatctcttcagtactatgagatcttgccaaattgttttacaaaatggttgtatcaatttttacttccctattggtgttcctgttttattatatttttatccatttggaattatcagacttttttttcgtttctttttttttttttttttttttggagacagagctttgctcttgttgcccaggctggagtgcagtggtgcgatctcggctcaccacaacctccatctcccgggttcaagcgattctcctgcctcagcctcccaagtagctgggattacaggcaggtgccaccatgcccggctaattttgtattttagtagagacggggtttttccatgatggtcaggctggtctcgaactcctgacctcaggtgatccatctgcctcggcctcccaaagcgctgggattacaggcatgagccaccacgcctggccttgagttatcagacttttgttcatctaatgagtaaaatgggatttcattgtagttttatgttattttccctgagtaagggataaagtgtgttttcgtgtttgtagctatttgggtctattcctctctgaattacttgttcatatatgtgttcatctgtcttttgggttaattgtctttttcttattaagttttagaagatctttaagtaatacaaatcctttataggttaagttgcactgattttcaattccataggaaagttcaaccgtctgaacttgtagggagtgtgtggaccaaagaagataaagaaataaattctccaaatttattaaaaatgattcgccataccacaaatctcaccctctggtttgaaaagtaagttttaatttactcttactacctcctaatagccataatattaagtcatatttaagctaaaattctggctactcataattatcttgttttctaagtgaggtgaagaaacttttctaagccatgaatttttgttgttgttagatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggtaagttttaggcttaactttttcatttttctcggggatgatgaaattagcataaaagaaatttcatctatcatctgtctttttaattaaattctttgtaaattcatccttgcttcataaatatgatataaatatattagaaaatatgttgatatattagttaatatatgaatatgatatataatatgtgaatcctaggcttatattagaaaatatatcaatattcaataaacaatatgagacttgcactgccgtgtaatgtacttaacctaaatgtaatgaagttccaagtggatttattcaataacacattgattgatagtctcaaatgacaaaggattttaaatataaaaatacaagtaatgtcttaattacctttaggtagtcaacaatagtataacacgggaagaactatttcaaaaacttaaatttggccaggcgtggtggctcacgcctgtaatcccagcactttaggaggctgaggcgggtcgatcacctgagctcaggagttcgaaaccaacctggacaacgcggcgaaaccccatctctactaaaaatacaaaaattagctgggcatggtggcgcacgcctgttatcccagctacttcggaggctgagacaggagaattgcttgaactcaggaggcagcatttgcagtgagctgagatcacaccactgcactccaggctgggcgacacagtgagactcagtctcaaaaaattaaaaaatatatatattttttaaattataaaatatgtgtttaacatgtactattgaaaattcaggagatatagaaaataggaagatattttgcatatatattttaataacaaaattgagattacattgtgcatagatttttatggcccttttctcataaacagttttctatttttttattagcttatcttcaaaaacaagattttaatggcatcaaggttttctatcatggataaatcataatttattccaacagtagattgtgggacaattaagttatttctgatttttttctgtgataatttatcatggaatattcatatgtagaagtctttttaagagcttgattatttccctagaaataatctaggggtggaaatcctgggtctgagtatttatatactttaagactttaaatacttttgccaaggtgtttcgtagcaggatacgataaatgccccttggtattatgtattatattaaaagcttttggccaggtgtgggggctctcacctgtaatcccaacactttgggaggcagagacaggaggatcacttgagcccaggagtttgagaccagcctgggcaacatagggagaccacatctctacaaaaaaaaaaaaaaaatagccaggcatggtgttgcatgcctctggcgggggcagaaatcgcactgcatttttaaattgtatgttaaaaaataactagtgaggctgggctcagtggctcacctgtaatcctagcactttgggaggccgaggcgggtggatcacctgaggtcaggagttcgataccagcctggctaacatgatgaaaccccatctctactaaaagtacaaaaattagtcaggcatggtggtatgtgctggtttgcaatcccagctactcaggaggctgaggcaggggtatcgcttgaacctgcctggtggaggttgcagtgagccaagattgccccactgcactctagcctgggcaacagagtgaaacttgttctcaaaataaataataactagtgaggttgaatatgtatttattgggtactttatgatttatgtattcattgcctctctcatttttgggggagggtgttttcattttgttgattttttttttttttttttcctaaagagtcaagcttgctctgtcacccaggctggagtgccagtggcatgatcatagcccactgcagtctcgaactcctgggctcaagggatcgtcctgtcccagcctcttgagtagctgcgattacaggcattagtcagcatgtccagctgcattttattcatttatatggatttttcatatattaaagatattaaaacttagactgtacatatattctcatttctgtttgtcttttatctgctttttaatttaaaaaatgtataatgctttgacataaggacgttttatcatttttatttagttgcacatatcagtctcttcacttatggtttcttcctttgcttttgtacctggaaagactttttttaagtaaaggataacaagttagaaactcagccatataaatactgcttttgggaatgtgcgtttttacaatctttctggaaagcagtctaacaatatatgttaaaattaaaaatgtgcatactcttaggacccagaattgcaaagaaataaacacaccagagtataaagttatatgtacaaagatatagttactgcagcattagttgtagtagcagaaaacaggaaacaacctgaatgtctatcagtaagagaatgattaaatacatcctcttatacctctattgtagaatattgttcagctatacaacaaagtgaatgggatctatgtgtattgttgtggaagaacatttgtgatatttcagcaggggaaaagcttcagaatgactataatattattccattttagtatcacaaagcagagcaaaccccaaacctctaagtggaactggataagtattgagaataatgtgggaggttacatactcctcttttaacattatttatttattttttttagtgggttgttattagaggggaatagaggaaaaactgctttatacatatatttttctgtttgggtgtttgcattttattgatttgtatgaactttatatgttaaagatattaatacttagtcaaatattatgaaataggccgggggcagtggctcatgcctgtaatcccaacactttgggaggctgaggtgggtggatcacatgaggccaggagtttgagaccagcctggccaacatgatgaaaccccgtctttactaaaaatataaaaattacccaggcatgctggcgggcgcctgtaatcccagctacttgggaggctgaggcaggagaatcacttgaacccgggaggcagaggttccagtgagccgagatcgcaccactgcactccagcctgtgcgacagagcaagattccatctcaaaaaaaaaaaaaaagaaatattaatgtatttaataaatgtgtcataaattgaatgcctatatctgtaggccttttgttggtctctctgttctgttcctttgatctatttgatcactcttgtgccagtgccactagtctaaactatcataactttatagtagtccttgatagagaagagtagggcaaatcctcgccaatcttactctttttcaggaggaacgtattcttggttctttgttctcctatatacattttagaatcaatttaagctccatttttttaaattggcattttgataggagttgcattggctctctaaatccaattacagattagtgaagaactgacatttttatagtaacaagtcttttcaactgtgaacatcgtttatctctttatttactcagttaataaagttttgtggggttttttttgttttgacagagatcgcatacctcttttgctagatgtatattagaattattttgttttcagtgacccttagagacagggtcatgctctgtcacccaggctggagtacagtggcatgatcatagcttactgcagcctcctattcccaggctcaaacagtcttcctaccttagtctcctgagtagtggggactataggcacgtgccaccctgctcagctaattttttaaattttatgtggagattgggcgttgctatgttgcgcagactggtttcgaactcctggcctcaaactattctcccaccccaacatctcaaagtgctgggattacaggtgtgagccactgcacttgaccagaattttttttttttttttttttttttttttttgagacagagtctcgctctgtcacccaggctggagtgcagtggcacaatctcggctcacggcaagctccacctcccaggttcatggcattctcctgcctcagcctcccgagtagctgggactacaggcacccgccaccacgcccggctaattttttgcatttttagtagagacggggtttcaccgtgttagccaggatggtcttgatcccctgacctcatgatccgcccgcctcagcctcccaaagtgctgggattacaggcgtgagccactgcacctggcctcagaattttttttaaatcctgatttctttattgatgatatctagaaatgcagttgatttttgtctattggttttatatatagcagcattgctgattctctcattaacattctatatgtagatttattggagtttcctcatgggcagtcatatcctctgtgtgaatagtgacatttttttttctttccaatctctagctctttatttcttatacttgtccatgctagctaggacttctgtatagtattgaataaaagctacaatgttatacccttggctttttccttgatttaaaggaaattgactgaatggttctccatcaagcatagtgttcgctctggggtttacgtgtgtgtgtatattctttctgaagtaaaaattaattttcaataagaagatctagtaatgaagtataaaagaaatgctagtttacttcattcactaaatttttgttcaagtcttcttgtcttctgatagttgtcttctccttaacaaaaccccaacctttagccccaaaagatctttcagtggaaaaatatttgaatgttcaggggttataattttcatcttctacagctatgacttgaaaccctggctagtcaaaataacgcacaaggcatgacgtagaattttttgtattgcttgatcttctaatttatatgagtaaattatgggttttatatttatagataaagagaggagaaatcacttcaggtaagtgtacaaaggaataccactcatcttttaatgtaaaaaaattgttttccagataatttgcaaaattttataaaatttaaaggtttgcatttataaaatatgattgaattgtaaaaaatttatactcaatttatgtatactttaaggcactgcaggaaaggaaaaggaaaattttggacgaagctgtggaattaagtcaagatcactttaaaaaatacctagtaaaacttaagtcaatcaatccaccttgtgtgcctttttttggtaagttactaaatatggatatattttgagggtgagcgtgtgatagccaaaagagagcagtcttcagaggcatgttatctttattttatatctgagctcatctacttttattagctctctgtattaataaataataaaactctctattttctataaaatgaagactataatatctcatagggttgttataaataaggattaaaaatattttgtctgtactacctaataagtctagcacataggacgcactcatgaaatggtaactgttatttttatcataactatctatgtcacatctacagtgtttgctttctctttaatttattaaaagcttctatgtgatttttaaatttagaattaaaatattgttgtgtatgattgaaattgaatgatttaaatcaagttttgtcaacttcaacaattttggtattttgggccaaataattctttgttgtgatgggctgtcgtgtgcgtaataggatctgtagcagcatcctggcctctattcattacactccaatagcaccctggagttgtggtaaccaaaaatgtctctagacattcctaaatatcccctgggggactaaattgtccccagctgagaaccaccaatttaaatgaatcagcaattacgcatgaaaaagggactaaaaacttttttattgttcatgaatgagaagtaattatttttctatctaaattacagtctctgaaaaaacagaattagtttataagcctatagacttattaaccaaaattggcttaaaattaatttattaataatcacctaagatacttggcattaaatatttataatcaaatattaaaatatttggtcagaatagatttaacacaatttgcacttggtgaaattagagtttagaaaagcttaatttgccatttcttagattagcagcctttatttttgtacaagccagtagcttttattttctttttattttaaattctttctctttaaaaaatgcttaatggagagttaatgattgtttatcagagacttaacattttagtagtagagttgctgaatagtataggatgtctttcaactttactagatcagttgttttcccaaataattgattaaataacaaaatttaaaataacttttctttaaattctttttttttttttactaggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgagggtaaatattttctttgcatatctttagaagagaacgtgttaatgggtaccaaaaaaaaaaaatagaatgaataagacatactattggatcgcacaacagggtgactacagtccataataatttaattgcagatttaaaagtaactgtaagaggccaggcactgtggctcacgcctgtaatcccagcactttgggaggccaaggcgggcggatcgcttgagatcaggagttggagaccagcctgggcagcatggcgaaaccccgtctctactaaaaatataaaaaaaaattagctgggcatggtgctgggtgcctgcagtcccagctactcaggagtctgaggtgggagaatcacttgagcctaggaggggtaggttgcagtgagccgagatagcgccactgcactccagcctgggtgacacagtaagacttctgtctcaaaataataatagtagtaataactataagtatcggctgggcatggtggctcacgcctgtaatcacagcactttgggaggctgaggcgggaggaccacttgaggtcaagaatttgagaccagcctgaccaacatggtgaaaccctgtctctactaaaaatacaaaaaattagccgggcatggtggcgggtgcctgtaatcccagctacttgggagactgaagcaggagaatcatttgaacccaggaggtggaggctgcagtgagccgagatcatgccactgccttccagcctgggtgacagagggagactccgtctcaaaaaataaaataaaaaatattaactataagagtataattggattattcataatacaaaggataaatgcttgagggaatggataccccactctccatgatgggattattctacattacatgcctgtatcaaaacatctcttataccctacaaatatatacacctattatgtacccatgaaaattaaaaattttaaaaattaaaaaaaaattttagatcttgtgtgacctgtaagaaatatcataattatttgtcttgctatgaaaataatagaaaaaaattaatcagtagatagcatgttaaacattagacattctacactatctgcagttgttaatattgttactaagtactttcttttgaaagtattgcttctttgtgtagttggttcaagctacaccataaaaagtgaatgacaaagtagaatgatgtccatgcagtaaaaagaaaattcatttctagatttgatagccattttagataatgttacatgtagcaaaataacgttatataattcataagaacagtgtgtttaaataggaaaagggtcagcaaagtggtatatgtatgcctggcagaagatgatttttctaacatcctgtcgattgatgttctattttgagcaatagtgtgtaatattgatactatagtactataaaatatgaaacaaccttctaaattaaactatgatattatgtttatgctaaatgaatgttattatattatacttgaacttgggaacatattataactatcaaccagaataagtttacgtgtcatattaaaaactgcgctaaactttttagacataatctgcatgcaaattgggcatattgagtgaaaatatccaccattacttccaccctcctaaattatgagatagaaacttctttgttcccggttcaaaacaaagtaccctaaagtcctaagaaaaagaccacctaaagcataccatttataaaaatgataggtcgggcacagtggctaatgcctgtaaatccagcactttgagaggctgaggtgggtggatcacctgaggtcaggagttcaagaccagcctggccaacgtggtgaaactctgtctccactaaaaatacaaaaattcgctgggtgtggtggcacgtgcttgtaatcccagctactcaggaggctgaggtgggaggatcgcttggacccagaaggcaaatgttgcagagaactgagatagagccactgcactctagcctaggtgacagagcgagactgcatctcaaaaaaaaaaaaaaaagatacttgctcttaaaaaaaataaaggtggtaacctactgatggtgacctatttcatcccctctcaccattgaacccgccctctgtgatgtggggcttcggagagctaaggaaatatggtccccacaggaataatgttacactttaattcggtatgcttgaaatagtacttttagtatttatatctcagaaccatacctgctaattggtgtttgtggtgtggtctagggttcctaccaccatttaaagcatttttgggaggaagtgtcttctatatgattgagtcaaacaaaataaatttaaaatgtagacaaagtagctattcacttttcaaatcatacttaaataaatagtatttaaaatagagcaaaggatgaggaaatcaagaatactgctgttatagctttctgaaagcctttaattactagtggctaatatttaatttagctaacctgaacataagaacacattgtttcagtattgttaaaagagtaatacaattttcttgaaattggcagaatgccttaaaaatgggaagaattttatactagaaattttaaagctcattttgcctactgctaaagctaaaacctagtaccatttttatatatgcttctaaaccacttcaaaattaaataaagctaaatccagtaatttgctgctaaggaatttttctaaggaaatcataaaaaatgtacagaaaaatttatatataggagttaataaaaataattattataatagcaaaaaattagaaagtacctatatggataactagctatatggagattattacattctgaaatatccatctgatgaaatactatagagttaaaatttgtattttgtaaaataagcaaactggctgggtgaggtggctcatacctgtaatcccagcactttggaaggctgagtgagactccatctcaaaaaaaaaaaaaaaaaaaaaagcaaaccacattgaaaaaagttaattgaatataaacttcagaaagattaaaattgatatcccagtttttcaggaaaatatatatataaattattaataattatatataaatacatatatacatgcatatatttacatgcacagtaaaatcattggaagatagtctaatatttaaatgtaaacaatgatatttctggtttgtaagattactgtttctttttctttttttctctttttttggcagtgctaaatcacctgaattttctacgttaaaacttaaatttaagcttaaaatattttttgataaagacaaaaattttaaacattttatttattaggctttttttaagaggagaggtctcaccatattgccctggctggtgtcaaattcctgggcttaagcagtcccccggcctcagcctcccaaactgctaggattacaggtgtgagccatcatggcttggctcagataaaaacattttttatactagaagttagcacagataggtttaactttataatcattctttctttctttctttctttctttctttttttttttttttttttttgagacagtctcgctcttgttgcccaggctggagtgcaatggtgtgatctcggttcacctcaacctccgcctgccaggttcaattgattctcctgtctcagcctcctgagtagctgggattacaggcatgcgccaccacgcccagctaattttgtatttttagtagagatggggtttcttcatgttggtcaggctggtctcaaactcccgacctcaggtgatccacccacctcagcctcccaaagtggtgggattacaggcgtgagccaccgtgctcggcctataatcattcttgacattacttttaaagtaatttaaatgactacttttaaagtaaaaggaatttccagagtaattataaatgatcaagaatgatctataaattggattaacagaccttaatctaatttatctccactttttttctgattatcaaaacttcattgtggattataaccatagctttgttctaaacacttttggtagcttactagtgatgatcatttgttacaatgagtaggagtaaagtttcctaaggaataagtagtgctactgctgagccattaaaatgataataaatgaaaactcatattcttaatagaactttaagactagaatataacttccacagaaattatataatcttattcagaagtaaagagattggaataagcaacacttgtgaacttttcacatattgtgggctcttaatgtgttattttttagcattaaataagtaattttcagcaaaaaattttaatgagatcttattttaataagatctaaaatatatacttactatatatgcacttgtgttatttgtttaattccagagattctttgaaaaccttaaccccatgggaagtgcatctgaaaaagagtttacagattatttgttcaacaagtcactagaaattgaacctcgaaactgcaaacagccacctcgatttgtaagtcttttataatttcgggaacaagtgttctgttttttaaaatattattttcaatgtttaacaacctgttatcttaaaaatgtaattgaatggctgttcctaggtgttttgtttgcagtaatatactatttctaaaactggggggggaaatgtcagccttttgataaaatctggtttatgccttatcttggtactacttatttatgtgtctacttttgatccctcctagaataatacaaaaaggtgtgagaaagtgagaacttaataggtagctgaatggaacagaaaaaaaaagaaaagacctgggaaggagtaagcaaatgtattttggttcttgtgacttgatatgacttctgccattagggctccatggtccatagttgcctctggaacccatctctgtcactagaatttgatgctacaatttccagttactgcaggagtttgcagtggcaacagaagtagtagaagatgaactctaagtagctaaaagtgaagcaagatatagaaggaagtaaaaacacaaaccaactttaggtgaagcaggaagtcaggtagtttcatgctatctcatcttcacaattgtgtgatatatgaggggacttcaaaaagttcatagagaccgggcatggtggctcacacctgtaatcccagcacattgggagaccaaggcaggcagattgcttcagttcaagagtttgagaccagcttgggcaacatggcaaaaccctgtctctaccaaaaatacaaaaaaattagccaggcatggtggtgcacgcctgggggcggaggttgcagtgagccaagatcactccacttcactccaacctgggtgacagagcaagaccccgtctcaaaaaaaaaaaaaaagaaaaaagaaaaaagaaaaaaagttcatggaaaaatggaatgaaaagataaatttttttgatggaattaaaagataaacataaaaacataaactttatttcccaacataagcttcctcaagttcaggacacttttgtaagcgctaataccaaccattttgtccatccctaaaaaactaaagatcctgggaatttaaccatatcattgcagtctcttttacattattaactgaagaaaaatggttgccctttaatttttttttttataattaggaaacaaaaaaagtcagaaggagccaagtcaagactgtaagtggatgcctaatgatctgccatcaaaactctcaaagaattgctctggtttaatgagagggatgagcaggagcattgttgtggtggagaaggtctccttggtgaagctttcctggttgtttttctgcaaaagctttggctaactttctcaaaacagtcccatagtaagcagatgttattgttctttgaccctctacaaactcaacaagaaaaatgccttgagcgtcctaaaaaactgttgccatgacctttctttttgtttttgttttgttttttttgagacagagtctcgctctgtcacccaggctggagtacagtggtgcaatctcaactcactgtaacctccacctcccaggttcaagcaattctactgcctcagcctcccacgtaactgggataacaggtgtgtgccactacgcccggctaatttttgtatttttaatagagatgaggtttcaccatgttggccaggcatgtcttgtactcctgacctcaagtgatccacctgcctcgacctcccaaagtgatgggattacaggtgtgagccaccatgcccagccttttttttttttttttttttttttaatggcaatagagtcttgctatattgcccaggctggtctcaaacccctggccttaaatgatcctcctgcctcagcctcccaaggtgctaggattacaggcatgagccactgtgcttggccaacctttgctcttgactgatttggttttgctttgactggaccacacttccacctcttggtagccattgctttgattgtgctttgtcttcaggatgatactgggaaaccgtgtttcatttcctattaacagtttttcaaacaaatgcttcagggtcttgatcccacttatttaacatttcattgaaagttttgctcttgtctgcagctgatctgggtgcagtggttttgccatccatctagtggaaagtttgctcaactttaatttttcagtcagaattgtataagctgaaccagttgagatatctgtggtgttggctatcatttctgttgttaatcataggtcctcttcaattagagcaggaatgagattttttcctcagaaattgatgttgatgatctgccgccattggctttaccttccatatcatctgatcccttgttaaaaatgagttatcaatttgtaaacagctgatttctttggggcattgtccccataaacttttcataaagtattagtgatctcaccattcttctacccaagcatcatcatggatttgatatttgttcttgcttcaattttagcagaattcgtgttcctctgatagggattctttacaaaccgatgtgttatccttcttagtatctcaaactagatatgtttgagtatctcaaactagatatgtttgagcatctcaaactgttcagacatgttataataagttagtatgagtttattttgatggaaaaaaatgaaagtcatgcatagttatttcataatagacatttgccatgcactttttgaaaacccctcatagatcttattctcattttacaaaggaaaatagtgagattccaaggggttaaataagtttttcaaggctgcatagctagatattggcacagttgagatcttaactcaagttttctgatctgagttctgtgttttttatttgattactcctgccagaacttgaaaaatgggacagaggtgatggtgggagacaatgataggaattttctccaaagatttttaaagcatcaatgtagaggttgatcatttagtataggaaggggaaaaaatgatcttttttttttctgaagcatatagcataatatgtttcataaattatgttcccagtaaatgtttgtaaaatctatatagatattttcaaagagaagtttaggttcatatgttttaggagtaaaatgtgattttcacataaaatttcaagaattttatttctgcagtgctgaaaagagacttacttatattccaattcattttaaaattaagccagtcaaatccagaagattctactagaatgatacaggctgtcattgcagactgaaggactgcacgcttaagaactgtatgcttaagaactaataagactaataaggtagctctaagtcacagaaacaaattgttgtctatgcaaatttgtgacattaattatgtttgcttttctcagcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggtaagtatttgatgtaaaccgcttggtaaaaaaggaatcctgtgtctcagataattcttatcattttaattagggaactatagaatcctttgcaaactatattagtgtgaaaagtgatatctaaatgtgaaaataatgattaatacaagaagtagagcataatttgtgcattgttgatgcatattatcttctaatttactcattcaacaaagatttgtttagtaccttttgggtcccactaccagtctaaagggagcaatagatgatgaataagaaaacaaatagataagttctgtgatagagggggaaccacttaatgctaagaaggaaaaccattctagatacagaaggttctgagttaattttttaaaaaactaacatggcaaaagatgatgataaaattctgcactgtgtattacgtattatttatggaaacatttaaaaaataatacctacatgttaccttccttttcaaattaatttttcttattccaataggcagcaatagcatctttgctccagtgcttttgccacattcaagtaagtataatttaagttgattcttaatgaaatgactgtaaagataataatctggttgattatatttgagtattttgagttttggcaatattaaagaacaagaaaagttataaataaatttaattatttgcttacaactgtgtactacttaagcttcactatagtttattttcatcattttttatgatctgttctaagggctgtatggccttgaagaaattacttaccttccccacacttgttaaggattaaatgaaataactgtatagaacacctagccgggtgtggtggctcacgcctgtaatcccagcactttgggaggccaaggcaggtggatcacgaggtcaggagttcaagaccagcctggccaacatagtgaaactctgtctctactaaaaaattacaaaaattagccggatatggtggtgcacgcctgtagtcccagctactcaggaggctgaggcaggagaatcacttgaacccaggaagcagaggttgtggtgagctgagatcaggccaccacactccagcctgggcaacggagtgagactccatctcaaaaaaagaaaacaacaaaacaaacaaacaaaaaaacaccatctaaaatattgcttggcatagaatgaatagtaatttcatgtcagttgtctttcttccttacccttttcaaatcattttcccatggcaataatatagtaaatgtttatcaggttcccgggatatcctcagtcacttatttttttttacatcatcttatttaattaaagcagtaaattttaagtaaagcactattctatcattcctaattatttcataatttataacttttaatgctgtaaactttctttctgtggtcatttgtttaaaacaaaataactcaaaaatgaacacagcacctttgggtataattctctcaatctggagaacatctgcttcgagcatagtaaaatatatagtagcaagtttccctatcttatgagaaaaataagcttagtcttttaaatgtttaattttatattttaggttaaaaaatttttatctggccaggcacagtggctcatacctgtaatcctaccactttgggaggctgaggcaggagtatcacttgaggtcagggcaacatagcagttcaagactagcctgggcaacatagcaagaccctgtcctccctaccaaaaaaaaatttatcaaagtgacatattaatagaatttaaaagggaaatagtgctaagacacttaaaatgaaattaacagtggttctctacctcaagtctccccactccttttcttgttctccaaggacacttccacatttctaaatgatgtttttgtagtctctcttgagtcattaattttagacaatgtttactgatctcctcttatggtggatgagaatttcatgtctaccctgcctatacttaaccacatttggggcaaatattattcactgctatgcttcctttcttgtatagctctgtttcctggagttcataattgcctcattaatgtttagatttgtttgtttgtttaggtttgtttgtatgtttgtttagcacctttccatgccctttcatagcagttttccataaagtcaggcaaatcagggaacctagcagggttttcctttttcttttcttttcgtttccctttccctttcccttctttctttcctagaatcttccttcctggtgcctttttgtcccccgttccagtttggactggttgatattcaggtattgaccctgctgtcatcctagaactttctttcattgtcatcctagaaattccctttgcctccctcctgtgttggatccttgtttttggattcctcatcttctttcttgatatgctccctgattttaataggagtagctcctttagtagctacgtgagaaaagataatacatatgacttaaactttttaagttattgcatatatggaaacctattatacctttttttgtttattttgtggaagcctattatacatttaattgttaatagtttagctggaaatagaatgtaaaaaataatttgactcagaattttgaactcattttcctccacggtcttctgcctttcataattcctgctgaaaagtctaataccattcatttacttactcagtacataatttttaaatgcctgataatgtgcaggcactattctagatgtgagagtgatagcagtgaatgaaatagacaaatatctttctctcaatgatcctacagtttcaatctttttttaaacttagagcatacttaacagtagcagaggacccaatgtcatacagagggacccaaatatacagagccttaaatgaaatagaagtttattcctcacaatagccagagcaagtaagcaactctgctccactgggttttccagctaagcagggcaattcagaattctcaagatgtgacttccatctctgtcttgagtacctgctgtagttgttaccattttctggctagcaggaagatggagggcaaggagctttgttataaaaacatgatctgggccgggcgcggtggctcacgactgtaatcccagcactttgggagaccgaggcagacagatcacctgaggtcaggagtttgagaccagactgaccaacatggtgaaaccccatctctactaaaaatacaaaaattagctgggcatagtggcgtgtgcctgtagtcccagctatttgggaggctgagacaggagaattgcttgaacccgggaggtggaggttgcagtgatccaagatcgtgtcattgcactccagcctggggcgacagagtgagactctgtctcaaaaaaaaaaaaaaaaaaaaggagaccttcttagttacaaaggaagctaagaaacgtctctaactaggtagccatttgccttaccaaaattcatgggatcctattactaaaaggaaaaagggaaaggtgtactgggaagcagcaggctctgccacaatatgttgaagaaacttttaaggcattctctttattcttaataatctacagcttcacaatgaactgcattgatgtgggtatttttttttttcattttgtcatctacttaatgagccctttaaatttagagattcgagtgttcgatttccagaaaatgcttcctgttgctttggtaataatttttcccccagcatgttctctgactccttttgtggagctcctttttcttattctcatacatcctagattgatcctccaattttcttgtcttttatcacctcttgtccatctctttgtcttcttgttctgttttcctggaagatttcctcactttatctttcagctcttctatttattttcttcatctgtcataattttaaatttctaagaattcttttcagttacctctgattgtgcctttttttaatagcatcctattctaatttcatggatgcactgtcttatctctcttaggataataattatagtatttttaaattttatttttaatcgacagataattgtatatgtttatggggtacaatctgatgttttgatacattgtggaatgatcaaatcagctaagttgcatatccagtggctgggcagggttggaccaggaaaggggagactttagtcaatggatgcaaagtttcagtgactatagttaataataatgtatatctctggatagataaaagagaagattttaaatgttctcaccacaaagaaatgatgaatatttgagatgatgaataattacagtatttttgaaaaaaaatttgttttgtttctagtgttgtctcttttctgacctcctttcttgtattagttgtagtctcttgtctttcatattggaggctttcctttcttgtccagtagtatttctgttcatattttagaatgagggggaaactgatgggaagtgctgtatctatatccatggcacttattgacttgtgggtttcactgtagagtgatggaatgataattttttacttaggaaatccccaaatgttagaatctgtaggcattttctctaagaatgtttagtttctctaaagaaggatctttgaatcttctgcctggggcaatctcgccatgtagtatggatatctgtgttttcagctcagactagtatcccaagtctggggtttagattttccggagaataaaactgccagtctcctacagaggtgggaatgaggtcattgcctggcctcactaagtaggggagaggagaatggggttctaactctcccttatccagacttaaccaagtcttctgttttcatgtccatgccttcctttgtaccaaatgcctttagctcctgaatccttatttggttctgtggggcagatttgctgctgcttgtcagtattactctctgtagggtttcatcttcctccatctgtctccatatacattataatctaccttcatgaattaaagcttcagcttcatatatttcctggctttattgaagtttgttgatatttcttatttttcttgttgttctgtggtggaaatgtcattacactattagtttcttagtactgccataacaaagcaccacaaactgagtagcttaaaagagcaaaaatgtattgtcccacagttctgaaggccagaaatccaaaatcgagatgttggcagggccatgtttactctgaaacttggagaagagaatccttccttgcttcttctaccttctggcatttgctggcaatccttggcatctcctgatttgtagatgcctcacttcagtctttgcctccattgtcatatggctgtcttctcgcggtatgtttctttatttcttctcctcttcttataaagacactggtcatgtcatattggatttggatccattttaatgacctcatcctaacttcattacatctgcaaagactatattccaaataaggtcacaattataggtactaggttatgggacttcatcatatctttgggggaacacaattcaacccataacactgtgccatcgtagaagtaggaattctagacattattttgaatggtagtaaaatacattttccatataagaaaattttacattttgaaatttaatagaaaattgagaataactgcattaaattctgaatattctaaaataaatccccaaagaaaataaaatattcatagcaagtatgaaaagtactcagatgaaatgagaaaaatggcaagactccattcacaatgaacatgggtacttcacatcaaaggaagtataccttgtaaagaaacatagataattatagatagttcagcatcattagaaatctgaggaattttacacaatagtgagttgccattttagtcttttgaattaatgtatttttttttgttttagtacgagcaagcctatggtaaaaggcacattacttatccccatgtaaattggtatattagtataacccttttggaatctgaatacaacatatcaaaccataaaaatgttcacaccctttgatgttactgattcagtagataattgaatacttagtttgtaccagttaccctgctaagcacaagagattcagtggcaaacaagaaagacaacgcctctgccttttatttatacaaaatacccaataaatgtttggaaaaagttacatgcatgaagattcatcctactgtctcgtcttttcttccacttcacttgtcactgcttggtctctcttgctggttcctcctcaccttcccaaactattgacattggaaggccttaggactcagtttctggacctcttctcactcacttggttgttcagtcttgtatcgtttacatgatgataattcccaagtttatatctagccagaacctctcttctgacttctagactcatatatttaattacccatttaacatctccagttggatatctaataggaatctcaaaccttacctgtctgaaactgagcttcttattatcccctccaaagttgttcctctcactgcctcctcatctccattctaattacaagcatccagttacttaggctaaaaatagtgtaatagaagtatcttttacttctctccctttctcacacgccaaatgtgacctatcaacaaatcttgactactctcaaaatatatccagaatctaacaattttttgccatctccactgctgccaccctggtccaagccaccataacttttaccttgtttattacagtaagcatcctgacttattatcttctccacttcagtatgtttttagtagagcagccagaatgatccttttagaatctgagttagaccttgttttacttgtgcttaaagccctctggtgggccgggtacggtggctcacccctgtaatcccagcactttgggaggccaaggcaggcggatcacctgaggtcaggagttggagaccagcctggccaacatggtgaaaccccgtctctactaaaaatacaaaaattagctgggcctggttgcaggcacctgtaatcccagcatactcaggaggctgaagcaggagaattgcttgaatccgggaggcggaggttgcagtgagctgagatcacaccactgctctccagcctgggcgacaagagtgaaactccatctcaaaaaaaaaaaaaaaaaagccctctggtggctttccatctcactcacagtgaaagccggttcctttaaagaacgcacaggccctacacagtttgggcttgtttgatctgtcagacctcatcacttattctcccccttcactcagtctgcctcaacataatagacacattattgcatcagtgctttgctcttgccattcctgctgtttataatacttttcagccatttagcctcacagcctgctcccttacctccttcaggctgttaccttagtgaagccttccctaatcaccctatttatgttgctcccctcccacctctttctatacccctttccaaccaaatatttcttgtcataatttataggcatcatacttttacttatctttccctaacctagattataagttccataaggacgtgaatttttgagttttgttcacggttatattgctagtgcttcagacagtgcctgacagtattagcaggtgcccaataactgttgaatgaatgaatgaatggcagaaaattagaagtaacttagatagctaactaacattacagaaattgtttagtaaattctgctatattcaccagtttggaataaatgcaggcactaaaaaagttcataaagactgtagtcttgtagggaaatgctcttgatagacaattaaattgcattcagacttcagcaagggttattgattgcctaccgtggagaaatatactggttaagtggtgactgtagagtcagacccagattcagagctctcatagctttcccatcattcacatatcatctgcttccatgagtgtgcgtgtctgttaccacctaagactggcttaatcaataagaaaacactcagacatacttggaagcctagaggaaggctgctttaagactggttgattcagtgactcgatgatgtaattaaagaccagggttcctggactccagcctgggcgacagagcgagacaccgtctcaaaaaaaaaaaaaaaaaaaaaagcccagggttctttttcactcttcattgttttgtccagattatcagcttgatttaaagctgttttccctcaaaatcataactggcaagagcagtaaaggttgtgtgcttctttgttcagtcaaattatatatagagagaagtacagacaagacagtatgacagaatgcgtttccaaaaaagagcaaggaacttcctttccattagcccccagaatatctccttttaaatttcactggtctgaattaggttacatgcctacagttaaactcatcactctggctaaaggaatgggattactctgattgatttataccaattaggccccatccctggagctaaggggtcaggttcactttccctaaaaaaatggctacttgcatgaaagagaggtagataaaaatctgatcatgttaagaaagtgagtcccatgcctattccttgccttgaattggggtgtcctgggcaggattggccaactaaaccaaatgggacagatttaccaccaccgaaaggagttctcccaaagacgggacaaacaatgctggcaggtctgaggaacatcctctgcctaacctccccacaccatctgccaacctcataggcataccttttgtatcagctatttccccctgagccaacaggacacccccgcagaagtaactgcagagccacatgactgagatagcaatttttgacatagaataattagtttgacatatctacttggatgtctcataagcagttcagttcagagtgtttaggaacatcctctgcctaacctccccacaccatctgccaacctcataggcgtaccttttgtatcagctatttccccctgagtcaacaggactcccccccctcccccaggaagtaactgcagagccacatgatcgggatagcaatttttgacatagaataattagtttgacatatctacttggatgtctcataagcagttcagttagagtgtttaaagttaaacttatcaacttctttcccagttagcgcctgtgttcccaatctcagtataatgacaaataagacatagttgctgcctttgtaacaactgtgtgaatatagagagatcaaatgggaagttgaactatagaaaaaattaaaatgaagatagtaattattatatgtctggttgatctgtttaggggtattttcctgtcatttatcattttgtaaatttcctttaatgtagttatataacgtgtacattatcagtgagagacttgcaaagacaaagagttatgtgatataacactaccttatgggttcctatatggagggttttattacctgtgtggtgatgtgcccaatcatagctgcttcaaaaatatacggtctcgcagggcacggtggttcatgcctgtaatcctagcactttgggaggccgaggtgggcggatcacaaggtcaggagtttgagaccagcctgaccaacatggtgaaaccctgtctctactaaaaatacaaaaattagctgggggtggtagtgggtacctgtaatcccagctactcaggaggctgaggcaggagaattgcttgaacccgggaggcggaggttgcagtgagccgagatcgtgccattgcactccagcctaggcgacagagtgggactccgtctcaaaaaaaaaaaaaaaaaaaaaggtctctgattaggatggtctttctttggaagttactacagtgtatttagacatgttttgttttgatttgtgaaaggcttttcagggagcagaatctcattaatcataattaaatagtacaccttcatttagctgaagtacccatcatgccccaggcactatggttggtgctagagacacagaaataaatacacactccctgcagaaagcttacaatttaatgggggaagatagataaaccaatagttgatacagtctgacaaatgccatggtagaagtatcgatcacaaattgtgataaaggtttatcttatactgtgaattgtggttaaactagtctttttctcccccagagtctttctttagttcatgtggtagtttacataaactaagtgaagagcccctgattcctcctcctcttcctcctcgaaaaaagtttgatcatgatgcttcaaattccaaggtaatcaacaggactttactccaacttattcaaagttgtgaatcttcaaaataatgcctagtgttataaagagtctgtgaattatactttggctaccatttatggtttttcagcatttgggttgttatatttgaaaaatacttttagttgtttaatccttataaaaaccttttctaaataagaggctgggccgggcgcagtggctcatgccaggcgggtagatcacctgagatcaggagttcgagaccagcctggtcaacatgatgaaaccccatctctactaaaaatacaaaaaattagctgggtgtggtggcgggtgcctgtgattccagctactggggaggctgaggcaggagaagcgcttgaacctgggagttggaggttgcagtgagccaggatcgtgccactgcactccagtctgggcaacaattgcaaaactcttgtctcaaaaaaaaaaaaaaaaaaaaaaaaggctggttgggaggctgaggcaggcagatcatctgaagtcaggagttcaagaccagcctggccaatatggtgaaaccctgtctctactaaaaatacaaaaattagccgggcatggtggcgggcacctgtaatcccagctactcaagaggctaaggcaggagaatcacttgaacctgggaggtgaaggtaggttgcagtgagccaagatcgcaccattgcactccagcctgggcgacagagcaagactctgtctcaaaaactaaaaataaaaataaaaaaataaaaaagaggctggaagtacattttctttctggtacaggtggaaaaaaacttcagtagtattccaagtattcttcaaactttcaactaatgcttctcaaaattttaagggtgcatcagaattacctgaaaggcttggtaaaatcagactgtggagccacacctccagagtttctgattcagtagtctaggatggggcccaagaatttgcttttctaacaagttccctactgatgctgatgttgttggtctctggatcacactttgagatctactgctctaagcctcactggagaaagtagcagtagatgcccagtaagcagaagctagacattaaagtcctctagacatcatgtcctttcatgtctataaagcaataaattattgtcacttacctactattataattaaaatacataaatttctgaaatgtatacacaaagcaagataaagagttaggacctaagacttaaattaaaacatctcatatataaaaatattaaacccagccctgaattaatctaggagtactcataatctgataattaacccagattagtttattttgagcctctgaatttaacttgacaagtaagaatttttcagacttaaaaatttttttttttaatttttcagaatagaggtataatttaattacttttttttttgagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatggtatttgtaaagttttttttttaatttattcaaaaaaagacatagtattttagtactttttacaaataatgctcttacaaaaatgctactgatcaaataagcttttaagaattggaaaaataaaaatacaaaagtccttcaccattatcctcaggtgatcagtagcattgccttgtcttggatcctcagtgctgccaaaaggccagtataaagaatttatatttgcactgtaaactctgcaaaaatatggtttaaagtgacatgattgcactgaaaagggatagtgcttttgtgaaatttttcaaatttgagtaatagatgcctttttaaggcagtgaatttacacaaatatgggaggggtatatggtgttactgatttttaaacctctttgaccatcttctagtttttacttctagtttttacatctaggagaattgtgaataacaccaactgttcttaaactctttaatgccatgtcttaaatgccggtatttgctgctgaagacaaaaatgaaaagtaggatgaaaataatagaatggcactgtaagtgtttattattttgtcaaaatgtaaacaaagactacataacccaatgatggagggaaaaagggcatgtatctcattcagatgtgccttttgtttttgcagactatgacgtctttagctaatgaattgcctattgttatggaaaacagttaatatgccatgtatgtacagttttgtttatattgtatatttaaagatactgctaataacctatataaatttaagtgacttgaggcctataatacaatctgctactttactaattcataaattcaaaaaaaattctatggcataggaaccaactgccttgccttcaagacctagtaactttctctataaatctcgtgttaactgaaattttttttaaatatattttttagattggtaatatttaaaccagcaaatacttaaagctttattaaacattttaatcagataagtgagtaaagcttttatttgccatttggatgccttcgttcaaagtgatagagtgttttgctgatagtgctgtagcagcagttgtaaagtagccaaaagccacgttgtttatttactggtttgtggccttttactgtgctttgtatcagagttcttaacaagattaataaatcaccccagtcttaatttttaaaa

SEQ ID NO: 4 - RNA, 4059 nt, Homo sapiens
  source 1..4059: mol_type = mRNA
gatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatgg

SEQ ID NO: 5 - RNA, 3960 nt, Homo sapiens
  source 1..3960: mol_type = mRNA
gatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagccctcatcccttagctggcagctgttttgaagatttggcagaagagcaagcatttgatccttatgaaacattatcacaggacattctttcaccagagtttcatgaacatttcaataaattgatggccagacctgcagttgctctacactttcagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatgg

SEQ ID NO: 6 - RNA, 4052 nt, Homo sapiens
  source 1..4052: mol_type = mRNA
gatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttgcaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaatcatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacact

SEQ ID NO: 7 - RNA, 3999 nt, Homo sapiens
  source 1..3999: mol_type = mRNA
atgcagcaggcgccgcagccttacgagttcttcagcgaggagaacagtccgaaatggcggggactgttggtctcggccctgcggaaggttcaggttcaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaaccctgttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgtatacgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatcaccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacactagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttagggtacttaatgtattccgccattgggttgaccatcattattatgactttgaaagagacctggaattgctggaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttgatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaagaaagggaaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatga

SEQ ID NO: 8 - RNA, 4033 nt, Homo sapiens
  source 1..4033: mol_type = mRNA
gtacaaaaaagttggcaccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaattgccaactttcttgtac

SEQ ID NO: 9 - RNA, 4131 nt, Homo sapiens
  source 1..4131: mol_type = mRNA
gttcgttgcaacaaattgatgagcaatgcttttttataatgccaactttgtacaaaaaagttggcaccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaattgccaactttcttgtacaaagttggcattataagaaagcattgcttatcaatttgttgcaacgaac

SEQ ID NO: 10 - RNA, 4013 nt, Homo sapiens
  source 1..4013: mol_type = mRNA
gcgatcgccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgttcaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaagtttaaac

SEQ ID NO: 11 - RNA, 3763 nt, Homo sapiens
  source 1..3763: mol_type = mRNA
cggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactatgggcctctgcatagtccaccagtaggaacaggaactctgggttttactttggaggaggaggctgtctcggtggaatagcaggaggatcatca

SEQ ID NO: 12 - RNA, 4059 nt, Homo sapiens
  source 1..4059: mol_type = mRNA
gatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacgtagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatgg

SEQ ID NO: 13 - RNA, 4059 nt, Homo sapiens
  source 1..4059: mol_type = mRNA
gatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcacagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatgg

SEQ ID NO: 14 - RNA, 3960 nt, Homo sapiens
  source 1..3960: mol_type = mRNA
gatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacgtagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagccctcatcccttagctggcagctgttttgaagatttggcagaagagcaagcatttgatccttatgaaacattatcacaggacattctttcaccagagtttcatgaacatttcaataaattgatggccagacctgcagttgctctacactttcagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatgg

SEQ ID NO: 15 - RNA, 3960 nt, Homo sapiens
  source 1..3960: mol_type = mRNA
gatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcacagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagccctcatcccttagctggcagctgttttgaagatttggcagaagagcaagcatttgatccttatgaaacattatcacaggacattctttcaccagagtttcatgaacatttcaataaattgatggccagacctgcagttgctctacactttcagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatgg

SEQ ID NO: 16 - RNA, 4052 nt, Homo sapiens
  source 1..4052: mol_type = mRNA
gatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacgtagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttgcaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaatcatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacact

SEQ ID NO: 17 - RNA, 4052 nt, Homo sapiens
  source 1..4052: mol_type = mRNA
gatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcacagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttgcaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaatcatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacact

SEQ ID NO: 18 - RNA, 3999 nt, Homo sapiens
  source 1..3999: mol_type = mRNA
atgcagcaggcgccgcagccttacgagttcttcagcgaggagaacagtccgaaatggcggggactgttggtctcggccctgcggaaggttcaggttcaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacgctgttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgtatacgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatcaccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacactagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttagggtacttaatgtattccgccattgggttgaccatcattattatgactttgaaagagacctggaattgctggaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttgatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaagaaagggaaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatga

SEQ ID NO: 19 - RNA, 3999 nt, Homo sapiens
  source 1..3999: mol_type = mRNA
atgcagcaggcgccgcagccttacgagttcttcagcgaggagaacagtccgaaatggcggggactgttggtctcggccctgcggaaggttcaggttcaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaaccctgttcttctggtgaattaaactactatgatcttgtcagaactgaaatcacagaagaaagacagtatctacgggaattaaatatgatcataaaagtgtttcgagaagcctttctttctgatagaaagctgtttaaaccttctgtatacgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatcaccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacactagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttagggtacttaatgtattccgccattgggttgaccatcattattatgactttgaaagagacctggaattgctggaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttgatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaagaaagggaaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatga

SEQ ID NO: 20 - RNA, 4033 nt, Homo sapiens
  source 1..4033: mol_type = mRNA
gtacaaaaaagttggcaccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacgtagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaattgccaactttcttgtac

SEQ ID NO: 21 - RNA, 4033 nt, Homo sapiens
  source 1..4033: mol_type = mRNA
gtacaaaaaagttggcaccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcacagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaattgccaactttcttgtac

SEQ ID NO: 22 - RNA, 4131 nt, Homo sapiens
  source 1..4131: mol_type = mRNA
gttcgttgcaacaaattgatgagcaatgcttttttataatgccaactttgtacaaaaaagttggcaccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacgtagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaattgccaactttcttgtacaaagttggcattataagaaagcattgcttatcaatttgttgcaacgaac

SEQ ID NO: 23 - RNA, 4131 nt, Homo sapiens
  source 1..4131: mol_type = mRNA
gttcgttgcaacaaattgatgagcaatgcttttttataatgccaactttgtacaaaaaagttggcaccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcacagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaattgccaactttcttgtacaaagttggcattataagaaagcattgcttatcaatttgttgcaacgaac

SEQ ID NO: 24 - RNA, 4013 nt, Homo sapiens
  source 1..4013: mol_type = mRNA
gcgatcgccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacgtagttcttctggtgaattaaactactatgatcttgtcagaactgaaatcgcagaagaaagacagtatctacgggaattaaatatgatcataaaagtgtttcgagaagcctttctttctgatagaaagctgttcaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaagtttaaac

SEQ ID NO: 25 - RNA, 4013 nt, Homo sapiens
  source 1..4013: mol_type = mRNA
gcgatcgccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcacagaagaaagacagtatctacgggaattaaatatgatcataaaagtgtttcgagaagcctttctttctgatagaaagctgttcaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaagtttaaac

SEQ ID NO: 26 - RNA, 3763 nt, Homo sapiens
  source 1..3763: mol_type = mRNA
cggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacgtagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactatgggcctctgcatagtccaccagtaggaacaggaactctgggttttactttggaggaggaggctgtctcggtggaatagcaggaggatcatca

SEQ ID NO: 27 - RNA, 3763 nt, Homo sapiens
  source 1..3763: mol_type = mRNA
cggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcacagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactatgggcctctgcatagtccaccagtaggaacaggaactctgggttttactttggaggaggaggctgtctcggtggaatagcaggaggatcatca

SEQ ID NO: 28 - DNA, 4059 bp, Homo sapiens
  source 1..4059: mol_type = other DNA
gatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatgg

SEQ ID NO: 29 - DNA, 3960 bp, Homo sapiens
  source 1..3960: mol_type = other DNA
gatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagccctcatcccttagctggcagctgttttgaagatttggcagaagagcaagcatttgatccttatgaaacattatcacaggacattctttcaccagagtttcatgaacatttcaataaattgatggccagacctgcagttgctctacactttcagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatgg

SEQ ID NO: 30 - DNA, 4052 bp, Homo sapiens
  source 1..4052: mol_type = other DNA
gatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttgcaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaatcatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacact

SEQ ID NO: 31 - DNA, 3999 bp, Homo sapiens
  source 1..3999: mol_type = other DNA
atgcagcaggcgccgcagccttacgagttcttcagcgaggagaacagtccgaaatggcggggactgttggtctcggccctgcggaaggttcaggttcaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaaccctgttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgtatacgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatcaccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacactagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttagggtacttaatgtattccgccattgggttgaccatcattattatgactttgaaagagacctggaattgctggaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttgatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaagaaagggaaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatga

SEQ ID NO: 32 - DNA, 4033 bp, Homo sapiens
  source 1..4033: mol_type = other DNA
gtacaaaaaagttggcaccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaattgccaactttcttgtac

SEQ ID NO: 33 - DNA, 4131 bp, Homo sapiens
  source 1..4131: mol_type = other DNA
gttcgttgcaacaaattgatgagcaatgcttttttataatgccaactttgtacaaaaaagttggcaccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaattgccaactttcttgtacaaagttggcattataagaaagcattgcttatcaatttgttgcaacgaac

SEQ ID NO: 34 - DNA, 4013 bp, Homo sapiens
  source 1..4013: mol_type = other DNA
gcgatcgccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgttcaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaagtttaaac

SEQ ID NO: 35 - DNA, 3763 bp, Homo sapiens
  source 1..3763: mol_type = other DNA
cggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactatgggcctctgcatagtccaccagtaggaacaggaactctgggttttactttggaggaggaggctgtctcggtggaatagcaggaggatcatca

SEQ ID NO: 36 - DNA, 4059 bp, Homo sapiens
  source 1..4059: mol_type = other DNA
gatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacgtagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatgg

SEQ ID NO: 37 - DNA, 4059 bp, Homo sapiens
  source 1..4059: mol_type = other DNA
gatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcacagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatgg

SEQ ID NO: 38 - DNA, 3960 bp, Homo sapiens
  source 1..3960: mol_type = other DNA
gatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacgtagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagccctcatcccttagctggcagctgttttgaagatttggcagaagagcaagcatttgatccttatgaaacattatcacaggacattctttcaccagagtttcatgaacatttcaataaattgatggccagacctgcagttgctctacactttcagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatgg

SEQ ID NO: 39 - DNA, 3960 bp, Homo sapiens
  source 1..3960: mol_type = other DNA
gatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcacagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagccctcatcccttagctggcagctgttttgaagatttggcagaagagcaagcatttgatccttatgaaacattatcacaggacattctttcaccagagtttcatgaacatttcaataaattgatggccagacctgcagttgctctacactttcagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatgg

SEQ ID NO: 40 - DNA, 4052 bp, Homo sapiens
  source 1..4052: mol_type = other DNA
gatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacgtagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttgcaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaatcatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacact

SEQ ID NO: 41 - DNA, 4052 bp, Homo sapiens
  source 1..4052: mol_type = other DNA
gatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcacagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttgcaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaatcatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacact

SEQ ID NO: 42 - DNA, 3999 bp, Homo sapiens
  source 1..3999: mol_type = other DNA
atgcagcaggcgccgcagccttacgagttcttcagcgaggagaacagtccgaaatggcggggactgttggtctcggccctgcggaaggttcaggttcaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacgctgttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgtatacgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatcaccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacactagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttagggtacttaatgtattccgccattgggttgaccatcattattatgactttgaaagagacctggaattgctggaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttgatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaagaaagggaaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatga

SEQ ID NO: 43 - DNA, 3999 bp, Homo sapiens
  source 1..3999: mol_type = other DNA
atgcagcaggcgccgcagccttacgagttcttcagcgaggagaacagtccgaaatggcggggactgttggtctcggccctgcggaaggttcaggttcaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaaccctgttcttctggtgaattaaactactatgatcttgtcagaactgaaatcacagaagaaagacagtatctacgggaattaaatatgatcataaaagtgtttcgagaagcctttctttctgatagaaagctgtttaaaccttctgtatacgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatcaccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacactagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttagggtacttaatgtattccgccattgggttgaccatcattattatgactttgaaagagacctggaattgctggaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttgatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaagaaagggaaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatga

SEQ ID NO: 44 - DNA, 4033 bp, Homo sapiens
  source 1..4033: mol_type = other DNA
gtacaaaaaagttggcaccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacgtagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaattgccaactttcttgtac

SEQ ID NO: 45 - DNA, 4033 bp, Homo sapiens
  source 1..4033: mol_type = other DNA
gtacaaaaaagttggcaccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcacagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaattgccaactttcttgtac

SEQ ID NO: 46 - DNA, 4131 bp, Homo sapiens
  source 1..4131: mol_type = other DNA
gttcgttgcaacaaattgatgagcaatgcttttttataatgccaactttgtacaaaaaagttggcaccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacgtagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaattgccaactttcttgtacaaagttggcattataagaaagcattgcttatcaatttgttgcaacgaac

SEQ ID NO: 47 - DNA, 4131 bp, Homo sapiens
  source 1..4131: mol_type = other DNA
gttcgttgcaacaaattgatgagcaatgcttttttataatgccaactttgtacaaaaaagttggcaccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcacagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaattgccaactttcttgtacaaagttggcattataagaaagcattgcttatcaatttgttgcaacgaac

SEQ ID NO: 48 - DNA, 4013 bp, Homo sapiens
  source 1..4013: mol_type = other DNA
gcgatcgccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacgtagttcttctggtgaattaaactactatgatcttgtcagaactgaaatcgcagaagaaagacagtatctacgggaattaaatatgatcataaaagtgtttcgagaagcctttctttctgatagaaagctgttcaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaagtttaaac

SEQ ID NO: 49 - DNA, 4013 bp, Homo sapiens
  source 1..4013: mol_type = other DNA
gcgatcgccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcacagaagaaagacagtatctacgggaattaaatatgatcataaaagtgtttcgagaagcctttctttctgatagaaagctgttcaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaagtttaaac

SEQ ID NO: 50 - DNA, 3763 bp, Homo sapiens
  source 1..3763: mol_type = other DNA
cggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacgtagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactatgggcctctgcatagtccaccagtaggaacaggaactctgggttttactttggaggaggaggctgtctcggtggaatagcaggaggatcatca

SEQ ID NO: 51 - DNA, 3763 bp, Homo sapiens
  source 1..3763: mol_type = other DNA
cggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcacagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaatggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactatgggcctctgcatagtccaccagtaggaacaggaactctgggttttactttggaggaggaggctgtctcggtggaatagcaggaggatcatca

SEQ ID NO: 52 - protein, 1332 aa, Homo sapiens [sequence omitted]

SEQ ID NO: 53 - protein, 1299 aa, Homo sapiens
MQQAPQPYEFFSEENSPKWRGLLVSALRKVQEQVHPTLSANEESLYYIEELIFQLLNKLCMAQPRTVQDVEERVQKTFPHPIDKWAIADAQSAIEKRKRRNPLLLPVDKIHPSLKEVLGYKVDYHVSLYIVAVLEYISADILKLAGNYVFNIRHYEISQQDIKVSMCADKVLMDMFDQDDIGLVSLCEDEPSSSGELNYYDLVRTEIAEERQYLRELNMIIKVFREAFLSDRKLFKPSDIEKIFSNISDIHELTVKLLGLIEDTVEMTDESSPHPLAGSCFEDLAEEQAFDPYETLSQDILSPEFHEHFNKLMARPAVALHFQQLKACSEEQEDRECLNQAITALMNLQGSMDRIYKQYSPRRRPGDPVCPFYSHQLRSKHLAIKKMNEIQKNIDGWEGKDIGQCCNEFIMEGPLTRIGAKHERHIFLFDGLMISCKPNHGQTRLPGYSSAEYRLKEKFVMRKIQICDKEDTCEHKHAFELVSKDENSIIFAAKSAEEKNNWMAALISLHYRSTLDRMLDSVLLKEENEQPLRLPSPEVYRFVVKDSEENIVFEDNLQSRSGIPIIKGGTVVKLIERLTYHMYADPNFVRTFLTTYRSFCKPQELLSLLIERFEIPEPEPTDADKLAIEKGEQPISADLKRFRKEYVQPVQLRILNVFRHWVEHHFYDFERDLELLERLESFISSVRGKAMKKWVESIAKIIRRKKQAQANGVSHNITFESPPPPIEWHISKPGQFETFDLMTLHPIEIARQLTLLESDLYRKVQPSELVGSVWTKEDKEINSPNLLKMIRHTTNLTLWFEKCIVEAENFEERVAVLSRIIEILQVFQDLNNFNGVLEIVSAVNSVSVYRLDHTFEALQERKRKILDEAVELSQDHFKKYLVKLKSINPPCVPFFGIYLTNILKTEEGNNDFLKKKGKDLINFSKRRKVAEITGEIQQYQNQPYCLRIEPDMRRFFENLNPMGSASEKEFTDYLFNKSLEIEPRNCKQPPRFPRKSTFSLKSPGIRPNTGRHGSTSGTLRGHPTPLEREPCKISFSRIAETELESTVSAPTSPNTPSTPPVSASSDLSVFLDVDLNSSCGSNSIFAPVLLPHSKSFFSSCGSLHKLSEEPLIPPPLPPRKKFDHDASNSKGNMKSDDDPPAIPPRQPPPPKVKPRVPVPTGAFDGPLHSPPPPPPRDPLPDTPPPVPLRPPEHFINCPFNLQPPPLGHLHRDSDWLRDISTCPNSPSTPPSTPSPRVPRRCYVLSSSQNNLAHPPAPPVPPRQNSSPHLPKLPPKTYKRELSHPPLYRLPLLENAETPQ

SEQ ID NO: 54 - protein, 1231 aa, Homo sapiens
RRGEAARALPVRPPARPAGCPRCGGAVAGAMQQAPQPYEFFSEENSPKWRGLLVSALRKVQEQVHPTLSANEESLYYIEELIFQLLNKLCMAQPRTVQDVEERVQKTFPHPIDKWAIADAQSAIEKRKRRNPLLLPVDKIHPSLKEVLGYKVDYHVSLYIVAVLEYISADILKLAGNYVFNIRHYEISQQDIKVSMCADKVLMDMFDQDDIGLVSLCEDEPSSSGELNYYDLVRTEIAEERQYLRELNMIIKVFREAFLSDRKLFKPSDIEKIFSNISDIHELTVKLLGLIEDTVEMTDESSPHPLAGSCFEDLAEEQAFDPYETLSQDILSPEFHEHFNKLMARPAVALHFQSIADGFKEAVRYVLPRLMLVPVYHCWHYFELLKQLKACSEEQEDRECLNQAITALMNLQGSMDRIYKQYSPRRRPGDPVCPFYSHQLRSKHLAIKKMNEIQKNIDGWEGKDIGQCCNEFIMEGPLTRIGAKHERHIFLFDGLMISCKPNHGQTRLPGYSSAEYRLKEKFVMRKIQICDKEDTCEHKHAFELVSKDENSIIFAAKSAEEKNNWMAALISLHYRSTLDRMLDSVLLKEENEQPLRLPSPEVYRFVVKDSEENIVFEDNLQSRSGIPIIKGGTVVKLIERLTYHMYADPNFVRTFLTTYRSFCKPQELLSLLIERFEIPEPEPTDADKLAIEKGEQPISADLKRFRKEYVQPVQLRILNVFRHWVEHHFYDFERDLELLERLESFISSVRGKAMKKWVESIAKIIRRKKQAQANGVSHNITFESPPPPIEWHISKPGQFETFDLMTLHPIEIARQLTLLESDLYRKVQPSELVGSVWTKEDKEINSPNLLKMIRHTTNLTLWFEKCIVEAENFEERVAVLSRIIEILQVFQDLNNFNGVLEIVSAVNSVSVYRLDHTFEALQERKRKILDEAVELSQDHFKKYLVKLKSINPPCVPFFGIYLTNILKTEEGNNDFLKKKGKDLINFSKRRKVAEITGEIQQYQNQPYCLRIEPDMRRFFENLNPMGSASEKEFTDYLFNKSLEIEPRNCKQPPRFPRKSTFSLKSPGIRPNTGRHGSTSGTLRGHPTPLEREPCKISFSRIAETELESTVSAPTSPNTPSTPPVSASSDLSVFLDVDLNSSCGSNSIFAPVLLPHSKSFFSSCGSLHKLSEEPLIPPPLPPRKKFDHDASNSKGNMKSDDDPPAIPPRQPPPPKVKPRVPVPTMGLCIVHQ

SEQ ID NO: 55 - protein, 1332 aa, Homo sapiens
MQQAPQPYEFFSEENSPKWRGLLVSALRKVQEQVHPTLSANEESLYYIEELIFQLLNKLCMAQPRTVQDVEERVQKTFPHPIDKWAIADAQSAIEKRKRRNPLLLPVDKIHPSLKEVLGYKVDYHVSLYIVAVLEYISADILKLAGNYVFNIRHYEISQQDIKVSMCADKVLMDMFDQDDIGLVSLCEDERSSSGELNYYDLVRTEIAEERQYLRELNMIIKVFREAFLSDRKLFKPSDIEKIFSNISDIHELTVKLLGLIEDTVEMTDESSPHPLAGSCFEDLAEEQAFDPYETLSQDILSPEFHEHFNKLMARPAVALHFQSIADGFKEAVRYVLPRLMLVPVYHCWHYFELLKQLKACSEEQEDRECLNQAITALMNLQGSMDRIYKQYSPRRRPGDPVCPFYSHQLRSKHLAIKKMNEIQKNIDGWEGKDIGQCCNEFIMEGPLTRIGAKHERHIFLFDGLMISCKPNHGQTRLPGYSSAEYRLKEKFVMRKIQICDKEDTCEHKHAFELVSKDENSIIFAAKSAEEKNNWMAALISLHYRSTLDRMLDSVLLKEENEQPLRLPSPEVYRFVVKDSEENIVFEDNLQSRSGIPIIKGGTVVKLIERLTYHMYADPNFVRTFLTTYRSFCKPQELLSLLIERFEIPEPEPTDADKLAIEKGEQPISADLKRFRKEYVQPVQLRILNVFRHWVEHHFYDFERDLELLERLESFISSVRGKAMKKWVESIAKIIRRKKQAQANGVSHNITFESPPPPIEWHISKPGQFETFDLMTLHPIEIARQLTLLESDLYRKVQPSELVGSVWTKEDKEINSPNLLKMIRHTTNLTLWFEKCIVEAENFEERVAVLSRIIEILQVFQDLNNFNGVLEIVSAVNSVSVYRLDHTFEALQERKRKILDEAVELSQDHFKKYLVKLKSINPPCVPFFGIYLTNILKTEEGNNDFLKKKGKDLINFSKRRKVAEITGEIQQYQNQPYCLRIEPDMRRFFENLNPMGSASEKEFTDYLFNKSLEIEPRNCKQPPRFPRKSTFSLKSPGIRPNTGRHGSTSGTLRGHPTPLEREPCKISFSRIAETELESTVSAPTSPNTPSTPPVSASSDLSVFLDVDLNSSCGSNSIFAPVLLPHSKSFFSSCGSLHKLSEEPLIPPPLPPRKKFDHDASNSKGNMKSDDDPPAIPPRQPPPPKVKPRVPVPTGAFDGPLHSPPPPPPRDPLPDTPPPVPLRPPEHFINCPFNLQPPPLGHLHRDSDWLRDISTCPNSPSTPPSTPSPRVPRRCYVLSSSQNNLAHPPAPPVPPRQNSSPHLPKLPPKTYKRELSHPPLYRLPLLENAETPQ

SEQ ID NO: 56 - protein, 1332 aa, Homo sapiens [sequence omitted]

SEQ ID NO: 57 - protein, 1299 aa, Homo sapiens
MQQAPQPYEFFSEENSPKWRGLLVSALRKVQEQVHPTLSANEESLYYIEELIFQLLNKLCMAQPRTVQDVEERVQKTFPHPIDKWAIADAQSAIEKRKRRNPLLLPVDKIHPSLKEVLGYKVDYHVSLYIVAVLEYISADILKLAGNYVFNIRHYEISQQDIKVSMCADKVLMDMFDQDDIGLVSLCEDERSSSGELNYYDLVRTEIAEERQYLRELNMIIKVFREAFLSDRKLFKPSDIEKIFSNISDIHELTVKLLGLIEDTVEMTDESSPHPLAGSCFEDLAEEQAFDPYETLSQDILSPEFHEHFNKLMARPAVALHFQQLKACSEEQEDRECLNQAITALMNLQGSMDRIYKQYSPRRRPGDPVCPFYSHQLRSKHLAIKKMNEIQKNIDGWEGKDIGQCCNEFIMEGPLTRIGAKHERHIFLFDGLMISCKPNHGQTRLPGYSSAEYRLKEKFVMRKIQICDKEDTCEHKHAFELVSKDENSIIFAAKSAEEKNNWMAALISLHYRSTLDRMLDSVLLKEENEQPLRLPSPEVYRFVVKDSEENIVFEDNLQSRSGIPIIKGGTVVKLIERLTYHMYADPNFVRTFLTTYRSFCKPQELLSLLIERFEIPEPEPTDADKLAIEKGEQPISADLKRFRKEYVQPVQLRILNVFRHWVEHHFYDFERDLELLERLESFISSVRGKAMKKWVESIAKIIRRKKQAQANGVSHNITFESPPPPIEWHISKPGQFETFDLMTLHPIEIARQLTLLESDLYRKVQPSELVGSVWTKEDKEINSPNLLKMIRHTTNLTLWFEKCIVEAENFEERVAVLSRIIEILQVFQDLNNFNGVLEIVSAVNSVSVYRLDHTFEALQERKRKILDEAVELSQDHFKKYLVKLKSINPPCVPFFGIYLTNILKTEEGNNDFLKKKGKDLINFSKRRKVAEITGEIQQYQNQPYCLRIEPDMRRFFENLNPMGSASEKEFTDYLFNKSLEIEPRNCKQPPRFPRKSTFSLKSPGIRPNTGRHGSTSGTLRGHPTPLEREPCKISFSRIAETELESTVSAPTSPNTPSTPPVSASSDLSVFLDVDLNSSCGSNSIFAPVLLPHSKSFFSSCGSLHKLSEEPLIPPPLPPRKKFDHDASNSKGNMKSDDDPPAIPPRQPPPPKVKPRVPVPTGAFDGPLHSPPPPPPRDPLPDTPPPVPLRPPEHFINCPFNLQPPPLGHLHRDSDWLRDISTCPNSPSTPPSTPSPRVPRRCYVLSSSQNNLAHPPAPPVPPRQNSSPHLPKLPPKTYKRELSHPPLYRLPLLENAETPQ

SEQ ID NO: 58 - protein, 1299 aa, Homo sapiens
MQQAPQPYEFFSEENSPKWRGLLVSALRKVQEQVHPTLSANEESLYYIEELIFQLLNKLCMAQPRTVQDVEERVQKTFPHPIDKWAIADAQSAIEKRKRRNPLLLPVDKIHPSLKEVLGYKVDYHVSLYIVAVLEYISADILKLAGNYVFNIRHYEISQQDIKVSMCADKVLMDMFDQDDIGLVSLCEDEPSSSGELNYYDLVRTEITEERQYLRELNMIIKVFREAFLSDRKLFKPSDIEKIFSNISDIHELTVKLLGLIEDTVEMTDESSPHPLAGSCFEDLAEEQAFDPYETLSQDILSPEFHEHFNKLMARPAVALHFQQLKACSEEQEDRECLNQAITALMNLQGSMDRIYKQYSPRRRPGDPVCPFYSHQLRSKHLAIKKMNEIQKNIDGWEGKDIGQCCNEFIMEGPLTRIGAKHERHIFLFDGLMISCKPNHGQTRLPGYSSAEYRLKEKFVMRKIQICDKEDTCEHKHAFELVSKDENSIIFAAKSAEEKNNWMAALISLHYRSTLDRMLDSVLLKEENEQPLRLPSPEVYRFVVKDSEENIVFEDNLQSRSGIPIIKGGTVVKLIERLTYHMYADPNFVRTFLTTYRSFCKPQELLSLLIERFEIPEPEPTDADKLAIEKGEQPISADLKRFRKEYVQPVQLRILNVFRHWVEHHFYDFERDLELLERLESFISSVRGKAMKKWVESIAKIIRRKKQAQANGVSHNITFESPPPPIEWHISKPGQFETFDLMTLHPIEIARQLTLLESDLYRKVQPSELVGSVWTKEDKEINSPNLLKMIRHTTNLTLWFEKCIVEAENFEERVAVLSRIIEILQVFQDLNNFNGVLEIVSAVNSVSVYRLDHTFEALQERKRKILDEAVELSQDHFKKYLVKLKSINPPCVPFFGIYLTNILKTEEGNNDFLKKKGKDLINFSKRRKVAEITGEIQQYQNQPYCLRIEPDMRRFFENLNPMGSASEKEFTDYLFNKSLEIEPRNCKQPPRFPRKSTFSLKSPGIRPNTGRHGSTSGTLRGHPTPLEREPCKISFSRIAETELESTVSAPTSPNTPSTPPVSASSDLSVFLDVDLNSSCGSNSIFAPVLLPHSKSFFSSCGSLHKLSEEPLIPPPLPPRKKFDHDASNSKGNMKSDDDPPAIPPRQPPPPKVKPRVPVPTGAFDGPLHSPPPPPPRDPLPDTPPPVPLRPPEHFINCPFNLQPPPLGHLHRDSDWLRDISTCPNSPSTPPSTPSPRVPRRCYVLSSSQNNLAHPPAPPVPPRQNSSPHLPKLPPKTYKRELSHPPLYRLPLLENAETPQ

SEQ ID NO: 59 - protein, 1231 aa, Homo sapiens
RRGEAARALPVRPPARPAGCPRCGGAVAGAMQQAPQPYEFFSEENSPKWRGLLVSALRKVQEQVHPTLSANEESLYYIEELIFQLLNKLCMAQPRTVQDVEERVQKTFPHPIDKWAIADAQSAIEKRKRRNPLLLPVDKIHPSLKEVLGYKVDYHVSLYIVAVLEYISADILKLAGNYVFNIRHYEISQQDIKVSMCADKVLMDMFDQDDIGLVSLCEDERSSSGELNYYDLVRTEIAEERQYLRELNMIIKVFREAFLSDRKLFKPSDIEKIFSNISDIHELTVKLLGLIEDTVEMTDESSPHPLAGSCFEDLAEEQAFDPYETLSQDILSPEFHEHFNKLMARPAVALHFQSIADGFKEAVRYVLPRLMLVPVYHCWHYFELLKQLKACSEEQEDRECLNQAITALMNLQGSMDRIYKQYSPRRRPGDPVCPFYSHQLRSKHLAIKKMNEIQKNIDGWEGKDIGQCCNEFIMEGPLTRIGAKHERHIFLFDGLMISCKPNHGQTRLPGYSSAEYRLKEKFVMRKIQICDKEDTCEHKHAFELVSKDENSIIFAAKSAEEKNNWMAALISLHYRSTLDRMLDSVLLKEENEQPLRLPSPEVYRFVVKDSEENIVFEDNLQSRSGIPIIKGGTVVKLIERLTYHMYADPNFVRTFLTTYRSFCKPQELLSLLIERFEIPEPEPTDADKLAIEKGEQPISADLKRFRKEYVQPVQLRILNVFRHWVEHHFYDFERDLELLERLESFISSVRGKAMKKWVESIAKIIRRKKQAQANGVSHNITFESPPPPIEWHISKPGQFETFDLMTLHPIEIARQLTLLESDLYRKVQPSELVGSVWTKEDKEINSPNLLKMIRHTTNLTLWFEKCIVEAENFEERVAVLSRIIEILQVFQDLNNFNGVLEIVSAVNSVSVYRLDHTFEALQERKRKILDEAVELSQDHFKKYLVKLKSINPPCVPFFGIYLTNILKTEEGNNDFLKKKGKDLINFSKRRKVAEITGEIQQYQNQPYCLRIEPDMRRFFENLNPMGSASEKEFTDYLFNKSLEIEPRNCKQPPRFPRKSTFSLKSPGIRPNTGRHGSTSGTLRGHPTPLEREPCKISFSRIAETELESTVSAPTSPNTPSTPPVSASSDLSVFLDVDLNSSCGSNSIFAPVLLPHSKSFFSSCGSLHKLSEEPLIPPPLPPRKKFDHDASNSKGNMKSDDDPPAIPPRQPPPPKVKPRVPVPTMGLCIVHQ

SEQ ID NO: 60 - protein, 1231 aa, Homo sapiens
RRGEAARALPVRPPARPAGCPRCGGAVAGAMQQAPQPYEFFSEENSPKWRGLLVSALRKVQEQVHPTLSANEESLYYIEELIFQLLNKLCMAQPRTVQDVEERVQKTFPHPIDKWAIADAQSAIEKRKRRNPLLLPVDKIHPSLKEVLGYKVDYHVSLYIVAVLEYISADILKLAGNYVFNIRHYEISQQDIKVSMCADKVLMDMFDQDDIGLVSLCEDEPSSSGELNYYDLVRTEITEERQYLRELNMIIKVFREAFLSDRKLFKPSDIEKIFSNISDIHELTVKLLGLIEDTVEMTDESSPHPLAGSCFEDLAEEQAFDPYETLSQDILSPEFHEHFNKLMARPAVALHFQSIADGFKEAVRYVLPRLMLVPVYHCWHYFELLKQLKACSEEQEDRECLNQAITALMNLQGSMDRIYKQYSPRRRPGDPVCPFYSHQLRSKHLAIKKMNEIQKNIDGWEGKDIGQCCNEFIMEGPLTRIGAKHERHIFLFDGLMISCKPNHGQTRLPGYSSAEYRLKEKFVMRKIQICDKEDTCEHKHAFELVSKDENSIIFAAKSAEEKNNWMAALISLHYRSTLDRMLDSVLLKEENEQPLRLPSPEVYRFVVKDSEENIVFEDNLQSRSGIPIIKGGTVVKLIERLTYHMYADPNFVRTFLTTYRSFCKPQELLSLLIERFEIPEPEPTDADKLAIEKGEQPISADLKRFRKEYVQPVQLRILNVFRHWVEHHFYDFERDLELLERLESFISSVRGKAMKKWVESIAKIIRRKKQAQANGVSHNITFESPPPPIEWHISKPGQFETFDLMTLHPIEIARQLTLLESDLYRKVQPSELVGSVWTKEDKEINSPNLLKMIRHTTNLTLWFEKCIVEAENFEERVAVLSRIIEILQVFQDLNNFNGVLEIVSAVNSVSVYRLDHTFEALQERKRKILDEAVELSQDHFKKYLVKLKSINPPCVPFFGIYLTNILKTEEGNNDFLKKKGKDLINFSKRRKVAEITGEIQQYQNQPYCLRIEPDMRRFFENLNPMGSASEKEFTDYLFNKSLEIEPRNCKQPPRFPRKSTFSLKSPGIRPNTGRHGSTSGTLRGHPTPLEREPCKISFSRIAETELESTVSAPTSPNTPSTPPVSASSDLSVFLDVDLNSSCGSNSIFAPVLLPHSKSFFSSCGSLHKLSEEPLIPPPLPPRKKFDHDASNSKGNMKSDDDPPAIPPRQPPPPKVKPRVPVPTMGLCIVHQ

SEQ ID NO: 61 - DNA, 23 bp, Homo sapiens
  source 1..23: mol_type = other DNA
agtgtcaatgtgtgcggataagg

SEQ ID NO: 62 - DNA, 23 bp, Homo sapiens
  source 1..23: mol_type = other DNA
gtgtgcggataaggttttgatgg

SEQ ID NO: 63 - DNA, 23 bp, Homo sapiens
  source 1..23: mol_type = other DNA
tgatcaggatgacataggtttgg

SEQ ID NO: 64 - DNA, 23 bp, Homo sapiens
  source 1..23: mol_type = other DNA
tttgatggacatgtttgatcagg

SEQ ID NO: 65 - DNA, 23 bp, Homo sapiens
  source 1..23: mol_type = other DNA
cattaaagtgtcaatgtgtgcgg

SEQ ID NO: 66 - DNA, 23 bp, Homo sapiens
  source 1..23: mol_type = other DNA
gaagatgaacctagttcttctgg

SEQ ID NO: 67 - DNA, 23 bp, Homo sapiens
  source 1..23: mol_type = other DNA
atgtttgatcaggatgacatagg

SEQ ID NO: 68 - DNA, 23 bp, Homo sapiens
  source 1..23: mol_type = other DNA
agaagaaagacagtatctacggg

SEQ ID NO: 69 - DNA, 23 bp, Homo sapiens
  source 1..23: mol_type = other DNA
tttaattcaccagaagaactagg

SEQ ID NO: 70 - DNA, 23 bp, Homo sapiens
  source 1..23: mol_type = other DNA
cagaagaaagacagtatctacgg

SEQ ID NO: 71 - DNA, 23 bp, Homo sapiens
  source 1..23: mol_type = other DNA
cagctttctatcagaaagaaagg

What is claimed is:

1. A method of treating a human patient having an ophthalmic condition, the method comprising administering a Son of Sevenless 2 (SOS2) inhibitor to the human patient, wherein the ophthalmic condition is increased intraocular pressure (IOP) or glaucoma, and wherein the SOS2 inhibitor comprises an antisense nucleic acid molecule, a small interfering RNA (siRNA), or a short hairpin RNA (shRNA) that hybridizes to an SOS2 mRNA, the method further comprising:

administering or continuing to administer to the human patient a therapeutic agent that treats or inhibits the ophthalmic condition in a standard dosage amount, and administering to the human patient the SOS2 inhibitor, when the human patient has been determined to be SOS2 reference; and administering or continuing to administer to the human patient a therapeutic agent that treats or inhibits the ophthalmic condition in an amount that is the same as or lower than a standard dosage amount, and administering to the human patient the SOS2 inhibitor, when the human patient has been determined to be heterozygous for an SOS2 predicted loss-of-function variant;

wherein the SOS2 predicted loss-of-function variant nucleic acid molecule is a nucleic acid molecule encoding SOS2 Pro191Arg (Isoform 1), SOS2 Ala208Thr (Isoform 1), SOS2 Pro191Arg (Isoform 2), SOS2 Ala208Thr (Isoform 2), SOS2 Pro221Arg, or SOS2 Ala238Thr; and wherein the presence of a genotype having an SOS2 predicted loss-of-function variant nucleic acid molecule encoding the human SOS2 polypeptide indicates the human patient has a reduced risk of developing an ophthalmic condition.

2. The method of claim 1, wherein the SOS2 predicted loss-of-function variant nucleic acid molecule is:

a genomic nucleic acid molecule having a nucleotide sequence comprising a guanine at a position corresponding to position 42,940 according to SEQ ID NO:2, or an adenine at a position corresponding to position 42,990 according to SEQ ID NO:3;

an mRNA molecule having a nucleotide sequence comprising: a guanine at a position corresponding to position 598 according to SEQ ID NO:12, a guanine at a position corresponding to position 598 according to SEQ ID NO:14, a guanine at a position corresponding to position 598 according to SEQ ID NO: 16, a guanine at a position corresponding to position 572 according to SEQ ID NO:18, a guanine at a position corresponding to position 591 according to SEQ ID NO: 20, a guanine at a position corresponding to position 640 according to SEQ ID NO:22, a guanine at a position corresponding to position 581 according to SEQ ID NO:24, or a guanine at a position corresponding to position 662 according to SEQ ID NO:26; or an adenine at a position corresponding to position 648 according to SEQ ID NO:13, an adenine at a position corresponding to position 648 according to SEQ ID NO:15, an adenine at a position corresponding to position 648 according to SEQ ID NO:17, an adenine at a position corresponding to position 622 according to SEQ ID NO:19, an adenine at a position corresponding to position 641 according to SEQ ID NO:21, an adenine at a position corresponding to position 690 according to SEQ ID NO:23, an adenine at a position corresponding to position 631 according to SEQ ID NO:25, or an adenine at a position corresponding to position 712 according to SEQ ID NO:27; or a cDNA molecule produced from an mRNA molecule, wherein the cDNA molecule has a nucleotide sequence comprising: a guanine at a position corresponding to position 598 according to SEQ ID NO:36, a guanine at a position corresponding to position 598 according to SEQ ID NO:38, a guanine at a position corresponding to position 598 according to SEQ ID NO: 40, a guanine at a position corresponding to position 572 according to SEQ ID NO:42, a guanine at a position corresponding to position 591 according to SEQ ID NO:44, a guanine at a position corresponding to position 640 according to SEQ ID NO:46, a guanine at a position corresponding to position 581 according to SEQ ID NO:48, or a guanine at a position corresponding to position 662 according to SEQ ID NO:50; or an adenine at a position corresponding to position 648 according to SEQ ID NO:37, an adenine at a position corresponding to position 648 according to SEQ ID NO:39, an adenine at a position corresponding to position 648 according to SEQ ID NO:41, an adenine at a position corresponding to position 622 according to SEQ ID NO:43, an adenine at a position corresponding to position 641 according to SEQ ID NO:45, an adenine at a position corresponding to position 690 according to SEQ ID NO:47, an adenine at a position corresponding to position 631 according to SEQ ID NO:49, or an adenine at a position corresponding to position 712 according to SEQ ID NO:51.

3. The method of claim 2, wherein the SOS2 predicted loss-of-function variant nucleic acid molecule is a nucleic acid molecule encoding SOS2 Pro191Arg (Isoform 1), SOS2 Ala208Thr (Isoform 1), SOS2 Pro191Arg (Isoform 2), or SOS2 Ala208Thr (Isoform 2).

4. The method of claim 1, wherein the SOS2 predicted loss-of-function variant nucleic acid molecule is a nucleic acid molecule encoding SOS2 Pro191Arg (Isoform 1), SOS2 Ala208Thr (Isoform 1), SOS2 Pro191Arg (Isoform 2), or SOS2 Ala208Thr (Isoform 2).

5. The method of claim 1, wherein the therapeutic agent that treats or inhibits the ophthalmic condition is selected from a prostaglandin, a beta blocker, an alpha-adrenergic agonist, a carbonic anhydrase inhibitor, a rho kinase inhibitor, or a miotic or cholinergic agent.

6. The method of claim 1, wherein the SOS2 inhibitor comprises an antisense nucleic acid molecule that hybridizes to an SOS2 mRNA.

7. The method of claim 1, wherein the SOS2 inhibitor comprises a small interfering RNA (siRNA) that hybridizes to an SOS2 mRNA.

8. The method of claim 1, wherein the SOS2 inhibitor comprises a short hairpin RNA (shRNA) that hybridizes to an SOS2 mRNA.

9. A method of decreasing SOS2 polypeptide expression in a cell in a human subject having an ophthalmic condition, the method comprising administering an SOS2 inhibitor to the human patient, wherein the ophthalmic condition is increased IOP or glaucoma, and wherein the SOS2 inhibitor comprises an siRNA that hybridizes to an SOS2 genomic nucleic acid molecule or mRNA molecule and decreases expression of the SOS2 polypeptide in the cell in the human subject.

* * * * *